(12) United States Patent
Poma et al.

(10) Patent No.: US 10,421,958 B2
(45) Date of Patent: Sep. 24, 2019

(54) METHODS OF SCREENING, SELECTING, AND IDENTIFYING CYTOTOXIC RECOMBINANT POLYPEPTIDES BASED ON AN INTERIM DIMINUTION OF RIBOTOXICITY

(71) Applicant: Molecular Templates, Inc., Georgetown, TX (US)

(72) Inventors: Eric Poma, New York, NY (US); Erin Willert, Round Rock, TX (US); Jason Kim, Austin, TX (US); Jack Higgins, Georgetown, TX (US)

(73) Assignee: MOLECULAR TEMPLATES, INC., Georgetown, TX (US)

( * ) Notice: Subject to any disclaimer, the term of this patent is extended or adjusted under 35 U.S.C. 154(b) by 0 days.

(21) Appl. No.: 15/117,174

(22) PCT Filed: Feb. 4, 2015

(86) PCT No.: PCT/US2015/014472
§ 371 (c)(1),
(2) Date: Aug. 5, 2016

(87) PCT Pub. No.: WO2015/120058
PCT Pub. Date: Aug. 13, 2015

(65) Prior Publication Data
US 2016/0355803 A1    Dec. 8, 2016

Related U.S. Application Data

(60) Provisional application No. 61/936,255, filed on Feb. 5, 2014.

(51) Int. Cl.
*C12N 15/10*    (2006.01)

(52) U.S. Cl.
CPC ..... *C12N 15/1062* (2013.01); *C12N 15/1037* (2013.01); *C12N 15/1041* (2013.01); *C07K 2319/00* (2013.01); *G01N 2500/20* (2013.01)

(58) Field of Classification Search
CPC .................................................. C12N 15/1062
USPC ........................................................... 506/9
See application file for complete search history.

(56) References Cited

U.S. PATENT DOCUMENTS

| | | | |
|---|---|---|---|
| 5,668,255 A | 9/1997 | Murphy | |
| 6,022,950 A | 2/2000 | Murphy | |
| 6,770,456 B1 * | 8/2004 | Coulie | C07K 14/4748 435/252.3 |
| 7,267,973 B2 | 9/2007 | Backer | |
| 7,700,557 B2 | 4/2010 | Backer | |
| 9,175,059 B2 | 11/2015 | Pieczykolan | |
| 2002/0168370 A1 | 11/2002 | McDonald | |
| 2004/0166565 A1 | 8/2004 | Backer | |
| 2009/0023649 A1 | 1/2009 | Backer | |
| 2009/0156417 A1 * | 6/2009 | Gariepy | C07K 7/06 506/9 |
| 2010/0093563 A1 * | 4/2010 | Williamson | C07K 16/00 506/17 |
| 2012/0039908 A1 * | 2/2012 | Combs | C07K 14/70503 424/158.1 |
| 2013/0196928 A1 | 8/2013 | Gariepy | |
| 2015/0259428 A1 | 9/2015 | Poma | |
| 2016/0017047 A1 | 1/2016 | Poma et al. | |
| 2016/0068577 A1 | 3/2016 | Poma et al. | |

FOREIGN PATENT DOCUMENTS

| | | |
|---|---|---|
| WO | WO-2005052006 | 6/2005 |
| WO | WO-2007107779 | 9/2007 |

OTHER PUBLICATIONS

Johannes et al. (Gene Therapy, 12, pp. 1360-1368). (Year: 2005).*
Gannon, VP, et al., "Molecular cloning and nucleotide sequence of another variant of the *Escherichia coli* Shiga-like toxin II family", Journal of General Microbiology 136(6), (1990), 1125-1135.
Peng, KW, et al., "Oncolytic measles viruses displaying a single-chain antibody against CD38, a myeloma cell marker", Blood 101(7), (2003), 2557-2562.
Ackerman, R. et al, "SLT-VEGF Reduces Lung Metastases, Decreases Tumor Recurrence, and Improves Survival in an Orthotopic Melanoma Model", Toxins (Basel), 2(9), (2010), 244-257.
Al-Jaufy, AY et al., "Cytotoxicity of a Shiga Toxin A Subunit-CD4 Fusion Protein to Human Immunodeficiency Virus-Infected Cells", Infection and Immunity, 62(3), (1994), 956-960.
Al-Jaufy, AY et al., "Purification and Characterization of a Shiga Toxin A Subunit-CD4 Fusion Protein Cytotoxic to Human Immunodeficiency Virus-Infected Cells", Infection and Immunity, 63(8), (1995), 3073-3078.
Backer, MV et al., "Shiga-like toxin-VEGF fusion proteins are selectively cytotoxic to endothelial cells overexpressing VEGFR-2", Journal of Controlled Release, 74(1-3), (2001), 349-355.
Backer, MV, Backer JM, "Targeting Endothelial Cells OVerexpressing VEGFR-2: Selective Toxicity of Shiga-like Toxin-VEGF Fusion Proteins", Bioconjugate Chemistry, 12(6), (2001), 1066-1073.
Bray, MR et al., "Probing the surface of eukaryotic cells using combinatorial toxin libraries", Current Biology, 11(9), (2001), 697-701.
Cheung, MC et al., "An evolved ribosome-inactivating protein targets and kills human melanoma cells in vitro and in vivo", Molecular Cancer, 9(28), (2010).

(Continued)

*Primary Examiner* — Karla A Dines
(74) *Attorney, Agent, or Firm* — Nixon Peabody LLP; Mark J. FitzGerald; Teresa A. Ptashka

(57) ABSTRACT

The present invention relates to methods of screening libraries of chimeric molecules comprising ribotoxic polypeptides, where screening is based on the interim reduction or elimination of ribotoxicity and the methods can identify cytotoxic molecules, each comprising a binding region and a ribotoxic region which jointly possess a desired assay-selectable characteristic, such as, e.g., binding to a target biomolecule, binding to a target cell, and/or cellular internalization.

23 Claims, 4 Drawing Sheets
Specification includes a S

(56) References Cited

OTHER PUBLICATIONS

Cizeau, J. et al., "Fusogenics: A Recombinant Immunotoxin-Based Screening Platform to Select Internalizing Tumor-Specific Antibody Fragments", Journal of Biomolecular Screening, 16(1), (2011), 90-100.

Hotz, B. et al., "Specific Targeting of Tumor Endothelial Cells by a Shiga-like Toxin—Vascular Endothelial Growth Factor Fusion Protein as a Novel Treatment Strategy for Pancreatic Cancer", Neoplasia, 12(10), (2010), 797-806.

Oloomi, M. et al., "In vivo Characterization of Fusion Protein Comprising of A1 Subunit of Shiga Toxin and Human GM-CSF: Assessment of Its Immunogenicity and Toxicity", Iranian Biomedical Journal, 14(4), (2010), 136-141.
Perampalam, S. et al., "Desigining combinatorial protein libraries based on a protein toxin template", HUPO 2nd Annual & IUBMB IXI World Congress, Oct. 8-11, Montreal, Poster Session 28 Proteomics & Biotechnology, Oct. 8, 2003-Oct. 11, 2003.
Perampalam, S., "Cell-Targeted Ribosome-Inactivating Proteins Derived From Protein Combinatorial Libraries", thesis, University of Toronto (Apr. 1, 2008).
Pirie, CM et al., "Convergent Potency of Internalized Gelonin Immunotoxins across Varied Cell Lines, Antigens, and Targeting Moieties", Journal of Biological Chemistry, 286(6), (2011), 4165-4172.
Protein ID ABM97743, European Molecular Biology Laboratory (EMBL), Oloomi, M. et al., "synthetic construct partial A1-GMCSF chimeric protein", Sep. 10, 2007.
Rajagopalan, S. et al., "CD20-Specific Engineered Toxin Body Demonstrates Direct Cell Kill of Multiple B-Cell Non-Hodgkin's Lymphoma Types", Blood, 122(21), (2013), 5152.
Rajagopalan, S. et al., "HER2-targeted engineered toxin body demonstrates selective binding and cell kill of HER2-overexpressing breast cancer", Proceedings: American Association for Cancer Research (AACR) Annual Meeting 2013, Poster, Abstract #868, (Apr. 6-10, 2013).
Rajagopalan, S. et al., "HER2-targeted engineered toxin body demonstrates selective binding and cell kill of HER2-overexpressing breast cancer", The Journal of Cancer Research, 73(8 Suppl): Abstract nr 868, (Apr. 15, 2013).
Rajagopalan, S. et al., "CD-20-specific Engineered Toxin Body demonstrates direct cell kill of multiple B-cell Non-Hodgkin's lymphoma types", Proceedings: American Association for Cancer Research (AACR) Annual Meeting 2014, Abstract #647, (Apr. 5-9, 2014).
Rajagopalan, S. et al., "CD20-specific Engineered Toxin Body demonstrates direct cell kill of multiple B-cell Non-Hodgkin's lymphoma types", The Journal of Cancer Research, 74(19 Suppl): Abstract nr 647, (Oct. 1, 2014).
Rajagopalan, S. et al., "CD38-specific engineered toxin body: Therapeutic potential for multiple myeloma", Proceedings: American Association for Cancer Research (AACR) Annual Meeting 2014, Abstract #671, (Apr. 5-9, 2014).
Rajagopalan, S. et al., "CD38-specific engineered toxin body: Therapeutic potential for multiple myeloma", The Journal of Cancer Research, 74(19 Suppl): Abstract nr 671, (Oct. 1, 2014).
Roudkenar, MH et al., "Selective cytotoxicity of recombinant STXA1-GM-CSF protein in hematopoetic cancer cells" Cell Biology and Toxicology, 22(3), (2006), 213-219.
Su, H. et al., "Clinical grade production and characterization of a fusion protein comprised of the chemokine CCL2-ligand genetically fused to a mutated and truncated form of the Shiga A1 subunit", Protein Expression and Purification, 66(2), (Jan. 1, 2009), 149-157.

* cited by examiner

Target biomolecule binding signal in a phage-ELISA assay of phage displaying a polypeptides comprising either catalytically inactive ribotoxic regions or a fully ribotoxic region

- α-HER2scFv::SLT-1A
- α-HER2scFv::SLT-1A-Y
- α-HER2scFv::SLT-1A-D
- α-HER2scFv::SLT-1A-DY
- α-CD20scFv::SLT-1A-Y

Figure 2

An exemplary spontaneous mutation in a ribotoxic region which occurred while screening a diverse phage display library designed with a fully ribotoxic, toxin-derived region

```
                L V Y
SLT-1A         TTTATATGT
               ||||  ||||
SLT-1A-Y77H    TTTACATGT
                L H V
                  *
```

Figure 3

A spontaneous mutation in a ribotoxic region recovered from protein display
screening a fully ribotoxic, diverse library exhibited a loss of ribosome inhibition activity

Figure 4

Multi-round enrichment of phage clones displaying αSLAMF7::SLT-1A-Y77S in a
non-ribotoxic library when selecting for binding to the target biomolecule SLAMF7

Figure 5

METHODS OF SCREENING, SELECTING, AND IDENTIFYING CYTOTOXIC RECOMBINANT POLYPEPTIDES BASED ON AN INTERIM DIMINUTION OF RIBOTOXICITY

SEQUENCE LISTING

The instant application contains a Sequence Listing which has been submitted electronically in ASCII format and is hereby incorporated by reference in its entirety. Said ASCII copy, created on Jun. 28, 2016, is named 14-02PCT_SL.txt and is 484,323 bytes in size.

FIELD OF THE INVENTION

The present invention relates to methods of screening molecular libraries in order to identify cytotoxic recombinant polypeptides, each polypeptide comprising a target binding region and ribotoxic region which jointly possess desired characteristics such as, e.g., target molecule binding affinity, target cell binding affinity, and/or target cell internalization.

BACKGROUND

Synthetic toxin structures have been designed in attempts to create new therapeutics that exhibit cell-targeted cytotoxicity after administration to a patient (see, Pastan I et al., *Annu Rev Med* 58: 221-37 (2007), for review). The aim of such molecular engineering is to design cytotoxic molecules comprising at least two functional domains: a cell-targeting region and a cytotoxic toxin region. A common type of such cytotoxic molecules is chimeric proteins comprising both a cell-targeting region and a toxin-derived cytotoxic region. One way to design cytotoxic chimeric proteins is to identify promising candidates or molecular frameworks by high-throughput screening of molecular libraries using technologies to select for desired characteristics, such as, e.g. high affinity target binding and/or cell internalization (see Poul M et al., *J Mol Biol,* 301: 1149-61 (2000); Levin A, Weiss G, *Mol Biosyst* 2: 49-57 (2006); Mazor Y et al., *J Immunol Methods* 321: 41-59 (2007); Bidlingmaier S et al., *Cancer Res* 69: 1570-7 (2009); Zou Y, Marks J, *Methods Enzymol* 502: 43-66 (2012)).

The purpose of molecular library screening is to search among a large diversity of molecules for those molecules with desired properties or functions. In particular, protein display technologies enable statistically powerful, high-throughput screening of large protein libraries in order to identify polypeptides which exhibit desired properties, such as specific molecular interactions (see, Glöckler J et al., *Molecules* 15: 2478-90 (2010), for review). For example, various protein display screening methods have been used to screen for protein-ligand interactions, such as bacteriophage display, bead-surface display, cell-surface display (prokaryotic or eukaryotic), RNA display, protein-DNA linkage display, ribosome display, and virus display. In particular, in vitro display technologies have become powerful tools for identifying immunoglobulin-type domains that bind human proteins for biomedical applications (Bradbury A et al., *Nat Biotechnol* 29: 245-54 (2011)).

In vitro display methods called bacteriophage display (phage display) became standard as early as 2005 (Hoogenboom H, *Nat Biotechnol* 23: 1105-16 (2005)). In particular, phage display screening of immunoglobulin domains was a major technological breakthrough (see McCafferty J et al., *Nature* 348: 552-4 (1990)). Phage display methods enabled the screening of relatively large polypeptide libraries (e.g. greater than $1\times10^9$ unique library members) and improved screening power. Later, the development of cell-free, in vitro protein display systems like RNA display, ribosome display, and protein-DNA linkage systems enabled widespread screening of even larger libraries (e.g. $1\times10^{15}$ unique library members).

Screening molecular libraries by protein display involves the en masse expression and screening of members of a protein library while maintaining a physical connection between phenotype and genotype, i.e. the displayed protein is physically linked to the nucleic acid encoding that individual protein. For example, 1) in phage display—each library polypeptide is part of the outer capsid of a phage particle containing genetic material encoding that specific polypeptide, 2) in yeast display—each library polypeptide is designed to form part of the outer cell wall of a yeast cell containing genetic material encoding that specific library polypeptide, 3) in ribosome display—each library polypeptide remains tethered to a ribosome physically associated with an RNA encoding that specific polypeptide, and 4) in RNA display—each library polypeptide is covalently coupled to an RNA encoding that specific polypeptide (Valencia C et al., *Methods* 60: 55-69 (2013)). The physical linkage of genotypes and phenotypes enables the screening of specific molecular interactions en masse while maintaining a connection between each library member and its individual genotype for identification of the biological sequence(s) associated with the desired phenotype(s).

Protein display technologies such as phage display, bacterial display, yeast display, RNA display, and ribosome display have all been widely used to screen for desired molecular affinity interactions (Chen T, Keating A, *Protein Sci* 21: 949-63 (2012)). Protein display screening may also be used to identify polypeptides with other characteristics or functions, such as cell binding and cellular internalization (Poul M et al., *J Mol Biol,* 301: 1149-61 (2000); Nielsen U et al., *Biochim Biophys Acta* 1591: 109-18 (2002); Liu B et al., *Cancer Res* 64: 704-10 (2004); Levin A, Weiss G, *Mol Biosyst* 2: 49-57 (2006); Mazor Y et al., *J Immunol Methods* 321: 41-59 (2007); Bidlingmaier S et al., *Cancer Res* 69: 1570-7 (2009); Zhou Y et al., *J Mol Biol* 404: 88-99 (2010); Zhou Y et al., *Arch Biochem Biophys* 526: 107-13 (2012); Zhou Y, Marks J, *Methods Enzymol* 502: 43-66 (2012)).

Chimeric fusion proteins represent one class of molecule that can be discovered and/or improved using protein display screening. Cytotoxic fusion proteins derived from certain toxins depend in part on a potent ribotoxicity not present in most proteins. Commonly, cytotoxic fusion proteins are derived from naturally occurring protein toxins which comprise a ribotoxic enzymatic domain (Pastan I, et al., *Annu Rev Med* 58: 221-37 (2007); Potala S, et al., *Drug Discov Today* 13: 807-15 (2008); Kreitman R, *Bio Drugs* 23: 1-13 (2009)). For example, certain toxins catalytically inhibit ribosome function, such as, e.g., ribosome inactivating proteins (RIPs) with ribosome N-glycosidase activity, including ricins, sarcins, Shiga toxins, abrins, gelonins, and saporins, and, e.g., bacterial AB toxins with ADP-ribosylation activity, including diphtheria toxins and *Pseudomonas* exotoxins (Shapira A, Benhar I, *Toxins* 2: 2519-83 (2010)). The cytotoxic mechanisms of all these toxins are based on the ability to inhibit protein translational via damaging ribosome function, i.e. ribotoxicity.

It is desirable to use protein display screening to discover and develop cytotoxic chimeric proteins comprising toxin-derived ribotoxic regions, such as, e.g., immunotoxins, ligand-toxin fusions, and immuno-RNases. Protein display screening may be used to identify novel chimeric cytotoxic polypeptides and/or optimize any selectable characteristic of a cytotoxic polypeptide, such as, e.g., target molecule binding affinity, cell targeting, cell binding, cellular internalization, subcellular routing, enzymatic activity, and cytotoxicity. However, effective protein display screening of libraries comprising toxin-derived polypeptides can be disrupted by the ribotoxic effects of toxin-derived polypeptide regions.

Protein display screening can be hindered by ribotoxicities present in expression libraries comprising toxin-derived ribotoxic regions. To work around this problem, ribotoxic polypeptides have mostly been developed in a piecemeal fashion by screening cell-targeting domains in the absence of any toxin-derived domain and then linking the two domains together to form cytotoxic chimeric molecules. Alternatively, in the few rare instances where protein display screening of ribotoxic polypeptides has been successful, success was only possible with relatively small libraries (e.g. $\sim 1 \times 10^4$ and $\sim 4 \times 10^5$) capable of significantly less power than possible using routine screening methods available for polypeptide expression libraries lacking toxin-derived ribotoxic domains (Cheung M et al., *Mol Cancer* 9: 28 (2010); Cizeau et al., *J Biomol Screen* 16: 90-100 (2011)).

Because most chimeric fusion proteins comprising ribotoxic regions have been developed in a piecemeal manner, with the cell-targeting region isolated separately from the ribotoxic region, this has resulted in the need for additional molecular engineering steps to build the complete chimeric structure, which might then acquire different physical and functional attributes. Moreover, the extra step of completing the chimeric structure by adding the cytotoxic component represents an additional inefficiency in the development process. Furthermore, even if the chimeric structure retains the desired functional activities of its components, the production process for making the final, cytotoxic, chimeric structure may require additional optimization steps which were not apparent when producing the cell-targeting and ribotoxic domains independently. For all these reasons and perhaps others, the current approaches of designing and producing toxin-derived, ribotoxic fusion proteins has commonly led to the selection of molecules with less than ideal properties (Weldon J, Pastan I, *FEBS J* 278: 4683-700 (2011)).

There remains a need in the art for methods of display screening libraries comprising toxin-derived, ribotoxic polypeptides in protein display formats which are more effective, more efficient, more statistically powerful, and minimize unwanted selection biases in order to more efficiently identify and select for ribotoxic proteins and polypeptides with more desirable properties such as, e.g., high-affinity, target-cell binding, promotion of cellular internalization, and ease of production.

SUMMARY OF THE INVENTION

The present invention provides improved methods for screening, selecting, and identifying cytotoxic proteins and polypeptides, in the context of two or more linked polypeptide regions, a ribotoxic region and a binding region, based on the interim reduction or elimination of ribotoxicity. The methods of the present invention may be used with any protein display system to select for one or more assay-selectable characteristics such as, e.g., target molecule binding affinity, target cell binding affinity, and/or target cell internalization. The reduction or elimination of ribotoxicity may be accomplished in at least two ways: 1) by using a non-ribotoxic form of the toxin region caused by one or more mutations in the ribotoxic region, and/or 2) by performing the screening and/or selecting in the presence of an inhibitor molecule of the appropriate ribotoxic region.

Certain embodiments of the methods of the present invention involve a variety of methods comprising the steps of 1) expressing a diverse library of recombinant polypeptides, each comprising a toxin-derived, ribotoxin region with reduced or eliminated ribotoxicity, using a protein display technology such that the polypeptides are displayed in functional form selectable by assay; 2) selecting among the polypeptides; and 3) identifying the amino acid sequence of a selected polypeptide for use in designing a ribotoxic polypeptide derived from the selected polypeptide but with a more ribotoxic, ribotoxic region. Certain other embodiments of the methods of the present invention involve a variety of methods comprising the steps recited above but using a diverse library of polypeptides, each comprising an unmodified ribotoxic region, wherein the steps are performed in the presence of an appropriate inhibitor of the ribotoxic region. The diverse library of polypeptides may comprise a plurality of polypeptides, each comprising a binding region which specifically binds to an extracellular target biomolecule in association with a target cell. Cytotoxic proteins and polypeptides identified using the screening methods of the present invention have a variety of uses, such as, e.g., for targeted cell-killing and as therapeutics in the treatment of a variety of diseases, disorders, and conditions, including cancers, immune disorders, and microbial infections.

One embodiment of the present invention is a method for identifying one or more cytotoxic proteins, wherein the cytotoxic protein comprises: (1) a ribotoxic region comprising a polypeptide and capable of inactivating a ribosome, and (2) a binding region comprising a polypeptide capable of binding at least one target biomolecule, and, wherein the method comprises the steps of: (a) providing a plurality of proteins, each molecule comprising: (1) a binding region capable of binding at least one target biomolecule and (2) a modified ribotoxic region that is modified from said ribotoxic region by at least one amino acid substitution, deletion, insertion, or addition, such that the modified ribotoxic region has reduced or eliminated ribotoxicity; (b) selecting from among the plurality of proteins for a protein with at least one assay-selectable characteristic; and (c) identifying the amino acid sequences of the polypeptide regions of a selected protein in order to construct one or more ribotoxic proteins deriving from or comprising the identified binding region associated with a more ribotoxic form of said modified ribotoxic region.

In certain embodiments of the present invention, the method further comprises, before step (a), providing an expression library of diverse nucleic acids, the steps off (a') providing a library comprising a plurality of diverse polynucleotides capable of encoding a plurality of binding regions, wherein at least two subsets of polynucleotides encode polypeptides with different binding regions, and (b') joining the polynucleotides of said library to a toxin template polynucleotide capable of encoding a modified ribotoxic region in an operable combination to construct an expression library of diverse nucleic acids capable of encoding a plurality of polypeptides, each comprising a binding region associated with said modified ribotoxic region.

In certain embodiments of the present invention, the method further comprises, before step (a), providing an expression library of diverse nucleic acids, the steps of: (a') providing a library comprising a plurality of diverse polynucleotides capable of encoding a plurality of binding regions, wherein at least two subsets of polynucleotides encode polypeptides with different said binding regions; (b') joining the polynucleotides of said library to a toxin template polynucleotide capable of encoding a modified ribotoxic region in an operable combination to construct an expression library of diverse nucleic acids capable of encoding a plurality of polypeptides, each comprising a binding region fused to said modified ribotoxic region; and (c') recombining the polynucleotides of said library of polynucleotides to an expression polynucleotide template to construct an expression library of diverse nucleic acids capable of expressing a plurality of polypeptides, each comprising a binding region fused to said modified ribotoxic region.

One embodiment of the present invention is a method for identifying one or more cytotoxic fusion polypeptides, wherein the cytotoxic fusion polypeptide comprises: (1) a ribotoxic region capable of inactivating a ribosome and (2) a binding region capable of binding at least one target biomolecule, and, wherein the method comprises the steps of: (a) providing an expression library of diverse nucleic acids constructed from a plurality of polynucleotides capable of encoding a plurality of fusion polypeptides, each fusion polypeptide comprising: (1) a binding region capable of binding at least one target biomolecule and (2) a modified ribotoxic region that is modified from said ribotoxic region by at least one amino acid substitution, deletion, insertion, or addition, such that the modified ribotoxic region has reduced or eliminated ribotoxicity; (b) expressing the expression library of diverse nucleic acids such that a plurality of fusion polypeptides are produced; (c) selecting from among the produced fusion polypeptides for an expressed fusion polypeptide with at least one assay-selectable characteristic; and (d) identifying the amino acid sequence of a selected fusion polypeptide in order to construct one or more ribotoxic fusion polypeptides comprising or deriving from the identified binding region fused to a more ribotoxic form of said modified ribotoxic region.

In certain further embodiments, the method further comprises the steps of: (e) producing said ribotoxic fusion polypeptide, wherein the producing step further comprises: (e1) providing a polynucleotide encoding said identified ribotoxic fusion polypeptide and, optionally (e2) expressing said polynucleotide using a host cell or cell-free translation system.

In certain embodiments of the present invention, the method further comprises, before step (a), providing an expression library of diverse nucleic acids, the steps of: (a') providing a library comprising a plurality of diverse polynucleotides capable of encoding a plurality of binding regions, wherein at least two subsets of polynucleotides encode polypeptides with different binding regions; and (b') joining the polynucleotides of said library to a toxin template polynucleotide capable of encoding a modified ribotoxic region in an operable combination to construct an expression library of diverse nucleic acids capable of encoding a plurality of fusion polypeptides, each comprising a binding region fused with said modified ribotoxic region.

In certain embodiments of the present invention, the method further comprises, before step (a), providing an expression library of diverse nucleic acids, the steps of: (a') providing a library comprising a plurality of diverse polynucleotides capable of encoding a plurality of binding regions, wherein at least two subsets of polynucleotides encode polypeptides with different said binding regions; (b') joining the polynucleotides of said library to a toxin template polynucleotide capable of encoding a modified ribotoxic region in an operable combination to construct an expression library of diverse nucleic acids capable of encoding a plurality of fusion polypeptides, each comprising a binding region fused to said modified ribotoxic region; and (c') recombining the polynucleotides of said library of polynucleotides to an expression polynucleotide template to construct an expression library of diverse nucleic acids capable of expressing a plurality of fusion polypeptides, each comprising a binding region fused to said modified ribotoxic region.

In certain further embodiments of the present invention, the modified ribotoxic region is derived from a toxin selected from the group consisting of: abrins, agrostin, amarandins, amaranthin, Amaranthus antiviral/RIP, angiogenin, *A. patens* RIPs, Articulatin D, asparins, aspergillin, Aspf1, balsamin, *B. hispida* RIP, bouganin, *Bougainvillea× buttiana* antiviral protein1, benincasins, bouganin, *B. rubra* RIPs, bryodins (e.g. bryodin 1, bryodin 2), *B. spectabilis* RIPs, *B. vulgaris* RIPs, *C. album* RIPs, camphorin, *C. aculeatum*-systemic resistance inducing protein, *C. cristata* RIPs, *C. figarei* RIPs, charantin, charybdin, cinnamomin, clavin, *C. moschata* RIP, cochinin B, colocins, crotins, cucurmosin, curcins, *Dianthus* spp. RIPs, *Corynebacterium* spp. diphtheria toxins (diphtheria toxins in *C. ulcerans, C. omega, C. pseudotuberculosis*), dodecandrins, ebulins, ebulitins, *E. hyemalis* RIPs, euserratins, eutirucallin, flammin, flammulin, foetidissimin, gelonin, gigantin, gypsophilin, *H. crepitans* RIPs, Heteropelalin, hispin, hirsutellin A, *H. orientalis* RIPs, *H. vulgare* RIPs, hypsin, insularin, *I. hollandica* RIPs, lagenin, lamjapin, lanceolin, *L. cylindrical* RIPs, luffacylin, luffaculin, luffagulin, luffins, *L. usitatissimum* RIPs, lychnin, lyophyllin, manutins, marmorin, mapalmin, *M. charantia* lectin, *M. crystallinum* RIPs, melonin, mexin, *Mirabilis* spp. RIPs, mitogillin, modeccins, MORs, *Mormordica* spp. RIPs, momorsgrovin, moschatin, musarmins, *N. tabacum* RIPs, nigrins, nigritins, ocymoidin, pachyerosin, *P. californicum* lectin, pepocin, petroglaucin, petrograndin, *Phytolacca* spp. RIPs (e.g. *P. dioica* RIPs PD-L1, PD-L2, PD-L3, PD-L4), pisavin, pleuturegin, Pluturegin, *A. thaliana* pectin methyl transferase (PME), *P. multiforum* RIPs, pokeweed antiviral protein (PAP), porrectin, *Aeromonas* spp. *Pseudomonas* toxins (*A. hydrophila pseudomonas*-like toxin), pulchellin, quinqueginsin, *R. communis* agglutinins, restrictocin, ricins, riproximin, saporins, sarcins, sativin, *S. cereale* RIPs, sechiumin, Shiga toxin, Shiga-like toxins, sieboldin b, *S. nigra* RIPs (e.g. *S. nigra* agglutinins I-V), *S. ocymoides* RIPs, *Spinacia oleracea* protein, stellarin, stenodactylin, texanin, tricholin, *Trichosanthes* spp. RIPs (e.g. karasurins, kirilowins, trichoanguin, trichokirins, trichosanthins, TYchi), *Triticum* spp. RIPs, *V. album* RIPs, velin, velutin, verotoxins, *V. hispanica* RIPs, vircumin, volkensin, *V. volvacea* RIPs, Volvarin, Yucca leaf protein, *Z. diploperennis* RIPs, *Z. mays* RIPs, and any ribotoxic fragment of any of the foregoing.

In certain further embodiments of the present invention, the binding region is selected from the group consisting of: complementary determining region 3 fragment, constrained FR3-CDR3-FR4 polypeptide, single-domain antibody fragment, single-chain variable fragment, antibody variable fragment, antigen-binding fragment, Fd fragment, fibronectin-derived 10$^{th}$ fibronectin type I domain, tenascin type III domain, ankyrin repeat motif domain, low-density-lipoprotein-receptor-derived A-domain, lipocalin, Kunitz domain, Protein-A-derived Z domain, gamma-B crystalline-derived domain, ubiquitin-derived domain, Sac7d-derived polypeptide, Fyn-derived SH2 domain, engineered antibody mimic, and any genetically manipulated counterparts of any of the foregoing that retain binding functionality.

In certain further embodiments of the present invention, the expression library is operable using the protein display method for selecting a specific characteristic selected from the group consisting of: bacteriophage display, RNA display, ribosome display, DNA display, bead surface display, virus display, microorganism display, and mammalian cell display.

In certain further embodiments of the present invention, at least one binding region is capable of binding to a target biomolecule found in physical association with at least one type of malignant cell. In certain further embodiments of the invention, at least one binding region is capable of binding to an extracellular target biomolecule found in physical association with at least one type of malignant cell. In certain further embodiments of the invention, at least one binding region is capable of binding to an intracellular target biomolecule found in physical association with at least one type of malignant cell. A malignant cell includes cells characterized as cancer cells, tumor cells, hyperplastic cells, infected cells, and abnormal cells.

In certain further embodiments of the present invention, the target biomolecule is selected from the group consisting of: CD20, CD22, CD40, CD79, CD25, CD30, HER2/neu/ErbB2, EGFR, EpCAM, EphB2, prostat-specific membrane antigen, Cripto, CDCP1, endoglin, fibroblast activated protein, Lewis-Y, CD19, CD21, CS1/SLAMF7, CD33, CD52, CD133, EpCAM, CEA, gpA33, mucin, TAG-72, carbonic anhydrase IX, folate binding protein, ganglioside GD2, ganglioside GD3, ganglioside GM2, ganglioside Lewis-Y2, VEGFR, Alpha Vbeta3, Alpha5beta1, ErbB1/EGFR, Erb3, fibroblast growth factor receptor, CD339, c-MET, IGF1R, EphA3, TRAIL-R1, TRAIL-R2, RANKL, FAP, tenascin, CD64, mesothelin, BRCA1, MART-1/MelanA, gp100, tyrosinase, TRP-1, TRP-2, MAGE-1, MAGE-3, GAGE-1/2, BAGE, RAGE, NY-ESO-1, CDK-4, beta-catenin, MUM-1, caspase-8, KIAA0205, HPVE6, SART-1, PRAME, carcinoembryonic antigen, prostate specific antigen, prostate stem cell antigen, human aspartyl (asparaginyl) beta-hydroxylase, EphA2, HER3/ErbB-3, MUC1, MART-1/MelanA, gp100, tyrosinase associated antigen, HPV-E7, Epstein-Barr virus antigen, Bcr-Abl, alpha-fetoprotein antigen, 17-A1, bladder tumor antigen, CD38, CD15, CD23, CD52, CD53, CD88, CD129, CD183, CD191, CD193, CD244, CD294, CD305, C3AR, FceRIa, galectin-9, mrp-14, Siglec-8, Siglec-10, CD49d, CD13, CD44, CD54, CD63, CD69, CD123, CD193, TLR4, FceRIa, IgE, CD107a, CD203c, CD14, CD15, CD33, CD64, CD68, CD80, CD86, CD105, CD115, F4/80, ILT-3, galectin-3, CD11a-c, GITRL, MHC class I molecule, MHC class II molecule, CD284-TLR4, CD107-Mac3, CD120, CD195-CCR5, HLA-DR, CD16/32, CD282-TLR2, CD11c, tumor necrosis factor alpha, and CD123, and any antigenic fragment of any of the foregoing.

In certain further embodiments of the present invention, the amino acid sequence of at least one said binding region of the expression library of diverse nucleic acids is derived from a chordate that has been immunized by an antigen or a nucleic acid capable of encoding an antigenic peptide. In certain further embodiments of the invention, the chordate is selected from the group consisting off birds, bovids, camelids, cartilaginous fishes, equines, lagomorphs, primates, rodents, and suiformes. In certain further embodiments of the invention, the antigen or antigenic peptide is derived from an amino acid sequence of the protein selected from the group consisting of: CD20, CD22, CD40, CD79, CD25, CD30, HER2/neu/ErbB2, EGFR, EpCAM, EphB2, prostat-specific membrane antigen, Cripto, CDCP1, endoglin, fibroblast activated protein, Lewis-Y, CD19, CD21, CS1/SLAMF7, CD33, CD52, CD133, EpCAM, CEA, gpA33, mucin, TAG-72, carbonic anhydrase IX, folate binding protein, ganglioside GD2, ganglioside GD3, ganglioside GM2, ganglioside Lewis-Y2, VEGFR, Alpha Vbeta3, Alpha5beta1, ErbB1/EGFR, Erb3, fibroblast growth factor receptor, CD339, c-MET, IGF1R, EphA3, TRAIL-R1, TRAIL-R2, RANKL, FAP, tenascin, CD64, mesothelin, BRCA1, MART-1/MelanA, gp100, tyrosinase, TRP-1, TRP-2, MAGE-1, MAGE-3, GAGE-1/2, BAGE, RAGE, NY-ESO-1, CDK-4, beta-catenin, MUM-1, caspase-8, KIAA0205, HPVE6, SART-1, PRAME, carcinoembryonic antigen, prostate specific antigen, prostate stem cell antigen, human aspartyl (asparaginyl) beta-hydroxylase, EphA2, HER3/ErbB-3, MUC1, MART-1/MelanA, gp100, tyrosinase associated antigen, HPV-E7, Epstein-Barr virus antigen, Bcr-Abl, alpha-fetoprotein antigen, 17-A1, bladder tumor antigen, CD38, CD15, CD23, CD52, CD53, CD88, CD129, CD183, CD191, CD193, CD244, CD294, CD305, C3AR, FceRIa, galectin-9, mrp-14, Siglec-8, Siglec-10, CD49d, CD13, CD44, CD54, CD63, CD69, CD123, CD193, TLR4, FceRIa, IgE, CD107a, CD203c, CD14, CD15, CD33, CD64, CD68, CD80, CD86, CD105, CD115, F4/80, ILT-3, galectin-3, CD11a-c, GITRL, MHC class I molecule, MHC class II molecule, CD284-TLR4, CD107-Mac3, CD120, CD195-CCR5, HLA-DR, CD16/32, CD282-TLR2, CD11c, tumor necrosis factor alpha, and CD123, and any antigenic fragment of any of the foregoing.

In certain further embodiments of the invention, the modified ribotoxic region is derived from any one of the amino acid sequences of SEQ ID NOs: 1-39 or any ribotoxic fragment thereof.

In certain further embodiments of the present invention, the modified ribotoxic region is derived from the amino acid sequence of the A Subunit of at least one member of the Shiga toxin family. In certain further embodiments of the present invention, the modified ribotoxic region comprises the mutation of the natively positioned amino acid residue of the A Subunit selected from the group comprising: N75, Y77, Y114, E167, R170, R172, R176, R179, R188, V191, W203, and L233.

One embodiment of the present invention is a method for producing a nucleic acid encoding a cytotoxic fusion polypeptide, said method comprising the steps of: (a) identifying the polypeptide sequence of a protein-display selected, fusion polypeptide using the method of any one of claims 1-15 and (b) creating a nucleic acid capable of encoding a cytotoxic fusion polypeptide comprising a binding region fused to a ribotoxic region and derived from said identified polypeptide sequence such that the ribotoxic region is more ribotoxic than the modified ribotoxic region of the identified polypeptide.

One embodiment of the present invention is a method for producing a nucleic acid library for identifying a cytotoxic fusion polypeptide, said method comprising the steps of: (a) providing a plurality of polynucleotides capable of encoding a plurality of binding regions capable of binding at least one target biomolecule and (b) joining said plurality of polynucleotides in an operable combination to a plurality toxin template polynucleotides capable of encoding a modified ribotoxic region that is modified from a ribotoxic region by at least one amino acid mutation such that the modified ribotoxic region has reduced or eliminated ribotoxicity, wherein the joined plurality of polynucleotides are each capable of encoding a fusion polypeptide comprising a binding region fused to said modified ribotoxic region.

One embodiment of the present invention is a method for producing an expression library for identifying a cytotoxic fusion polypeptide, said method comprising the steps of (a) providing a plurality of polynucleotides capable of encoding a plurality of binding regions capable of binding at least one target biomolecule, (b) joining said plurality of polynucleotides in an operable combination to a plurality of toxin template polynucleotides capable of encoding a modified ribotoxic region that is modified from a ribotoxic region by at least one amino acid mutation such that the modified ribotoxic region has reduced or eliminated ribotoxicity, and (c) joining said joined plurality of polynucleotides in operable combination to an expression vector to form an expression library capable of expressing a plurality of fusion polypeptides, each comprising a binding region fused to said modified ribotoxic region.

Certain embodiments of the present invention are the molecular libraries created by any one of the above methods wherein said modified ribotoxic region is derived from the amino acid sequence of the toxin selected from the group consisting of: abrins, agrostin, amarandins, amaranthin, Amaranthus antiviral/RIP, angiogenin, *A. patens* RIPs, Articulatin D, asparins, aspergillin, Aspf1, balsamin, *B. hispida* RIP, bouganin, *Bougainvilleaxbuttiana* antiviral protein1, benincasins, bouganin, *B. rubra* RIPs, bryodins (e.g. bryodin 1, bryodin 2), *B. spectabilis* RIPs, *B. vulgaris* RIPs, *C. album* RIPs, camphorin, *C. aculeatum*-systemic resistance inducing protein, *C. cristata* RIPs, *C. figarei* RIPs, charantin, charybdin, cinnamomin, clavin, *C. moschata* RIP, cochinin B, colocins, crotins, cucurmosin, curcins, *Dianthus* spp. RIPs, *Corynebacterium* spp. diphtheria toxins (diphtheria toxins in *C. ulcerans, C. omega, C. pseudotuberculosis*), dodecandrins, ebulins, ebulitins, *E. hyemalis* RIPs, euserratins, eutirucallin, flammin, flammulin, foetidissimin, gelonin, gigantin, gypsophilin, *H. crepitans* RIPs, Heterotepalin, hispin, hirsutellin A, *H. orientalis* RIPs, *H. vulgare* RIPs, hypsin, insularin, *I. hollandica* RIPs, lagenin, lamjapin, lanceolin, *L. cylindrical* RIPs, luffacylin, luffaculin, luffagulin, luffins, *L. usitatissimum* RIPs, lychnin, lyophyllin, manutins, marmorin, mapalmin, *M. charantia* lectin, *M. crystallinum* RIPs, melonin, mexin, *Mirabilis* spp. RIPs, mitogillin, modeccins, MORs, *Mormordica* spp. RIPs, momorsgrovin, moschatin, musarmins, *N. tabacum* RIPs, nigrins, nigritins, ocymoidin, pachyerosin, *P. californicum* lectin, pepocin, petroglaucin, petrograndin, *Phytolacca* spp. RIPs (e.g. *P. dioica* RIPs PD-L1, PD-L2, PD-L3, PD-L4), pisavin, pleuturegin, Pluturegin, *A. thaliana* pectin methyl transferase (PME), *P. multiforum* RIPs, pokeweed antiviral protein (PAP), porrectin, *Aeromonas* spp. *Pseudomonas* toxins (*A. hydrophila pseudomonas*-like toxin), pulchellin, quinqueginsin, *R. communis* agglutinins, restrictocin, ricins, riproximin, saporins, sarcins, sativin, *S. cereale* RIPs, sechiumin, Shiga toxin, Shiga-like toxins, sieboldin b, *S. nigra* RIPs (e.g. *S. nigra* agglutinins I-V), *S. ocymoides* RIPs, *Spinacia oleracea* protein, stellarin, stenodactylin, texanin, tricholin, *Trichosanthes* spp. RIPs (e.g. karasurins, kirilowins, trichoanguin, trichokirins, trichosanthins, TYchi), *Triticum* spp. RIPs, *V. album* RIPs, velin, velutin, verotoxins, *V. hispanica* RIPs, vircumin, volkensin, *V. volvacea* RIPs, Volvarin, Yucca leaf protein, *Z. diploperennis* RIPs, *Z. mays* RIPs, and any ribotoxic fragment of any of the foregoing.

In certain further embodiments of the present invention, the binding region of the library is selected from the group consisting of complementary determining region 3 fragment, constrained FR3-CDR3-FR4 polypeptide, single-domain antibody fragment, single-chain variable fragment, antibody variable fragment, antigen-binding fragment, Fd fragment, fibronectin-derived $10^{th}$ fibronectin type I domain, tenascin type III domain, ankyrin repeat motif domain, low-density-lipoprotein-receptor-derived A-domain, lipocalin, Kunitz domain, Protein-A-derived Z domain, gamma-B crystalline-derived domain, ubiquitin-derived domain, Sac7d-derived polypeptide, Fyn-derived SH2 domain, engineered antibody mimic, and any genetically manipulated counterparts of any of the foregoing that retain binding functionality.

In certain further embodiments of the present invention, the binding region of the library is operable using the protein display method for selecting a specific characteristic selected from the group consisting of: bacteriophage display, RNA display, ribosome display, DNA display, bead surface display, virus display, microorganism display, and mammalian cell display.

In certain further embodiments, at least one binding region of the library is capable of binding to a target biomolecule found in physical association with at least one type of malignant cell. In certain further embodiments of the invention, at least one binding region is capable of binding to an extracellular target biomolecule found in physical association with at least one type of malignant cell. In certain further embodiments of the invention, at least one binding region is capable of binding to an intracellular target biomolecule found in physical association with at least one type of malignant cell. A malignant cell includes cells characterized as cancer cells, tumor cells, hyperplastic cells, infected cells, and abnormal cells.

In certain further embodiments, the target biomolecule of at least one binding region of the library is selected from the group consisting of CD20, CD22, CD40, CD79, CD25, CD30, HER2/neu/ErbB2, EGFR, EpCAM, EphB2, prostate-specific membrane antigen, Cripto, CDCP1, endoglin, fibroblast activated protein, Lewis-Y, CD19, CD21, CS1/SLAMF7, CD33, CD52, CD133, EpCAM, CEA, gpA33, mucin, TAG-72, carbonic anhydrase IX, folate binding protein, ganglioside GD2, ganglioside GD3, ganglioside GM2, ganglioside Lewis-Y2, VEGFR, Alpha Vbeta3, Alpha5beta1, ErbB/EGFR, Erb3, fibroblast growth factor receptor, CD339, c-MET, IGF1R, EphA3, TRAIL-R1, TRAIL-R2, RANKL, FAP, tenascin, CD64, mesothelin, BRCA1, MART-1/MelanA, gp100, tyrosinase, TRP-1, TRP-2, MAGE-1, MAGE-3, GAGE-1/2, BAGE, RAGE, NY-ESO-1, CDK-4, beta-catenin, MUM-1, caspase-8, KIAA0205, HPVE6, SART-1, PRAME, carcinoembryonic antigen, prostate specific antigen, prostate stem cell antigen, human aspartyl (asparaginyl) beta-hydroxylase, EphA2, HER3/ErbB-3, MUC1, MART-1/MelanA, gp100, tyrosinase associated antigen, HPV-E7, Epstein-Barr virus antigen, Bcr-Abl, alpha-fetoprotein antigen, 17-A1, bladder tumor antigen, CD38, CD15, CD23, CD52, CD53, CD88, CD129, CD183, CD191, CD193, CD244, CD294, CD305, C3AR, FceRIa, galectin-9, mrp-14, Siglec-8, Siglec-110, CD49d, CD13, CD44, CD54, CD63, CD69, CD123, CD193, TLR4, FceRIa, IgE, CD107a, CD203c, CD14, CD15, CD33, CD64, CD68, CD80, CD86, CD105, CD115, F4/80, ILT-3, galectin-3, CD11a-c, GITRL, MHC class I molecule, MHC class II molecule, CD284-TLR4, CD107-Mac3, CD120, CD195-CCR5, HLA-DR, CD16/32, CD282-TLR2, CD11c, tumor necrosis factor alpha, and CD123, and any antigenic fragment of any of the foregoing.

In certain further embodiments of the libraries of the present invention, the amino acid sequence of at least one said binding region is derived from a chordate that has been immunized by an antigen or a nucleic acid capable of encoding an antigenic peptide. In certain further embodiments, the immunized chordate is selected from the group consisting of: birds, bovids, camelids, cartilaginous fishes, equines, lagomorphs, primates, rodents, and suiformes. In certain further embodiments, the antigen or antigenic peptide is derived from an amino acid sequence of the protein selected from the group consisting of: CD20, CD22, CD40, CD79, CD25, CD30, HER2/neu/ErbB2, EGFR, EpCAM, EphB2, prostate-specific membrane antigen, Cripto, CDCP1, endoglin, fibroblast activated protein, Lewis-Y, CD19, CD21, CS1/SLAMF7, CD33, CD52, CD133, EpCAM, CEA, gpA33, mucin, TAG-72, carbonic anhydrase IX, folate binding protein, ganglioside GD2, ganglioside GD3, ganglioside GM2, ganglioside Lewis-Y2, VEGFR, Alpha Vbeta3, Alpha5beta1, ErbB1/EGFR, Erb3, fibroblast growth factor receptor, CD339, c-MET, IGF1R, EphA3, TRAIL-R1, TRAIL-R2, RANKL, FAP, tenascin, CD64, mesothelin, BRCA1, MART-1/MelanA, gp100, tyrosinase, TRP-1, TRP-2, MAGE-1, MAGE-3, GAGE-1/2, BAGE, RAGE, NY-ESO-1, CDK-4, beta-catenin, MUM-1, caspase-8, KIAA0205, HPVE6, SART-1, PRAME, carcinoembryonic antigen, prostate specific antigen, prostate stem cell antigen, human aspartyl (asparaginyl) beta-hydroxylase, EphA2, HER3/ErbB-3, MUC1, MART-1/MelanA, gp100, tyrosinase associated antigen, HPV-E7, Epstein-Barr virus antigen, Bcr-Abl, alpha-fetoprotein antigen, 17-A1, bladder tumor antigen, CD38, CD15, CD23, CD52, CD53, CD88, CD129, CD183, CD191, CD193, CD244, CD294, CD305, C3AR, FceRIa, galectin-9, mrp-14, Siglec-8, Siglec-10, CD49d, CD13, CD44, CD54, CD63, CD69, CD123, CD193, TLR4, FceRIa, IgE, CD107a, CD203c, CD14, CD15, CD33, CD64, CD68, CD80, CD86, CD105, CD115, F4/80, ILT-3, galectin-3, CD11a-c, GITRL, MHC class I molecule, MHC class II molecule, CD284-TLR4, CD107-Mac3, CD120, CD195-CCR5, HLA-DR, CD16/32, CD282-TLR2, CD11c, tumor necrosis factor alpha, and CD123, and any antigenic fragment of any of the foregoing.

In certain further embodiments of the invention, the modified ribotoxic region is derived from SEQ ID NOs: 1-39 or any functional ribotoxic thereof.

In certain further embodiments of the libraries of the present invention, the modified ribotoxic region is derived from the amino acid sequence of the A Subunit of at least one member of the Shiga toxin family. In certain further embodiments of the present invention, the modified ribotoxic region comprises the mutation of the natively positioned amino acid residue of the A Subunit selected from the group comprising: N75, Y77, Y114, E167, R170, R172, R176, R179, R188, V191, W203, and L233.

One embodiment of the present invention is a method for identifying one or more cytotoxic proteins, wherein the cytotoxic protein comprises: (1) a ribotoxic region comprising a polypeptide and capable of inactivating a ribosome, and (2) a binding region comprising a polypeptide and capable of binding at least one target biomolecule, and, wherein the method comprises the steps of: (a) providing a plurality of proteins, each protein comprising: (1) a ribotoxic region comprising a polypeptide and capable of inactivating a ribosome and (2) a binding region comprising a polypeptide and capable of binding at least one target biomolecule; (b) selecting from among the plurality of proteins for one or more proteins with at least one assay-selectable characteristic in the presence of an inhibitor of the ribotoxic region; and (d) identifying the amino acid sequences of the polypeptide regions of a selected protein.

One embodiment of the present invention is a method for identifying one or more cytotoxic fusion polypeptides, wherein the cytotoxic fusion polypeptide comprises: (1) a ribotoxic region capable of inactivating a ribosome and (2) a binding region capable of binding at least one target biomolecule, and, wherein the method comprises the steps of: (a) providing an expression library of diverse nucleic acids constructed from a plurality of polynucleotides capable of encoding a plurality of fusion polypeptides, each fusion polypeptide comprising: (1) a ribotoxic region capable of inactivating a ribosome and (2) a binding region capable of binding at least one target biomolecule; (b) expressing the expression library of diverse nucleic acids such that a plurality of fusion polypeptides are produced; (c) selecting from among the produced fusion polypeptides for one or more fusion polypeptides with at least one assay-selectable characteristic in the presence of an inhibitor of the ribotoxic region; and (d) identifying the sequence of a selected fusion polypeptide.

In certain further embodiments of the present invention, the method further comprises the steps of: (e) producing said identified cytotoxic fusion polypeptide, wherein said producing step further comprises: (e1) providing a polynucleotide encoding said cytotoxic fusion polypeptide and (e2) expressing said polynucleotide using a host cell or cell-free translation system.

In certain further embodiments of the present invention, the method further comprises before step (a), the step of providing an expression library of diverse nucleic acids, the steps of (a') providing a library comprising a plurality of diverse polynucleotides capable of encoding a plurality of binding regions, wherein at least two subsets of polynucleotides encode polypeptides with different binding regions; and (b') joining the polynucleotides of said library to a toxin template polynucleotide capable of encoding a ribotoxic region in an operable combination to construct an expression library of diverse nucleic acids capable of encoding a plurality of fusion polypeptides, each fusion polypeptide comprising a binding region and said ribotoxic region.

In certain further embodiments of the present invention, the method further comprises before step (a), the step of providing an expression library of diverse nucleic acids, the steps of (a') providing a library comprising a plurality of diverse polynucleotides capable of encoding a plurality of binding regions, wherein at least two subsets of polynucleotides encode polypeptides with different said binding regions, (b') joining the polynucleotides of said library to a toxin template polynucleotide capable of encoding a ribotoxic region in an operable combination to construct an expression library of diverse nucleic acids capable of encoding a plurality of fusion polypeptides comprised by said binding regions and said ribotoxic region, and (c') recombining the polynucleotides of said library of polynucleotides to an expression polynucleotide template to construct an expression library of diverse nucleic acids capable of expressing a plurality of fusion polypeptides, each comprising a binding region and said ribotoxic region.

In certain further embodiments of the present invention, the ribotoxic region of the method is derived from a toxin selected from the group consisting of: abrins, agrostin, amarandins, amaranthin, Amaranthus antiviral/RIP, angiogenin, *A. patens* RIPs, Articulatin D, asparins, aspergillin, Aspf1, balsamin, *B. hispida* RIP, bouganin, *Bougainvillea× buttiana* antiviral protein1, benincasins, bouganin, *B. rubra* RIPs, bryodins (e.g. bryodin 1, bryodin 2), *B. spectabilis* RIPs, *B. vulgaris* RIPs, *C. album* RIPs, camphorin, *C. aculeatum*-systemic resistance inducing protein, *C. cristata* RIPs, *C. figarei* RIPs, charantin, charybdin, cinnamomin, clavin, *C. moschata* RIP, cochinin B, colocins, crotins, cucurmosin, curcins, *Dianthus* spp. RIPs, *Corynebacterium* spp. diphtheria toxins (diphtheria toxins in *C. ulcerans, C. omega, C. pseudotuberculosis*), dodecandrins, ebulins, ebulitins, *E. hyemalis* RIPs, euserratins, eutirucallin, flammin, flammulin, foetidissimin, gelonin, gigantin, gypsophilin, *H. crepitans* RIPs, Heterotepalin, hispin, hirsutellin A, *H. orientalis* RIPs, *H. vulgare* RIPs, hypsin, insularin, *I. hollandica* RIPs, lagenin, lamjapin, lanceolin, *L. cylindrical* RIPs, luffacylin, luffaculin, luffagulin, luffins, *L. usitatissimum* RIPs, lychnin, lyophyllin, manutins, marmorin, mapalmin, *M. charantia* lectin, *M. crystallinum* RIPs, melonin, mexin, *Mirabilis* spp. RIPs, mitogillin, modeccins, MORs, *Mormordica* spp. RIPs, momorsgrovin, moschatin, musarmins, *N. tabacum* RIPs, nigrins, nigritins, ocymoidin, pachyerosin, *P. californicum* lectin, pepocin, petroglaucin, petrograndin, *Phytolacca* spp. RIPs (e.g. *P. dioica* RIPs PD-L1, PD-L2, PD-L3, PD-L4), pisavin, pleuturegin, Pluturegin, *A. thaliana* pectin methyl transferase (PME), *P. multiforum* RIPs, pokeweed antiviral protein (PAP), porrectin, *Aeromonas* spp. *Pseudomonas* toxins (*A. hydrophila pseudomonas*-like toxin), pulchellin, quinqueginsin, *R. communis* agglutinins, restrictocin, ricins, riproximin, saporins, sarcins, sativin, *S. cereale* RIPs, sechiumin, Shiga toxin, Shiga-like toxins, sieboldin b, *S. nigra* RIPs (e.g. *S. nigra* agglutinins I-V), *S. ocymoides* RIPs, *Spinacia oleracea* protein, stellarin, stenodactylin, texanin, tricholin, *Trichosanthes* spp. RIPs (e.g. karasurins, kirilowins, trichoanguin, trichokirins, trichosanthins, TYchi), *Triticum* spp. RIPs, *V. album* RIPs, velin, velutin, verotoxins, *V. hispanica* RIPs, vircumin, volkensin, *V. volvacea* RIPs, Volvarin, Yucca leaf protein, *Z. diploperennis* RIPs, *Z. mays* RIPs, and any ribotoxic fragment of any of the foregoing.

In certain further embodiments of the present invention, at least one binding region of the method is selected from the group consisting of: complementary determining region 3 fragment, constrained FR3-CDR3-FR4 polypeptide, single-domain antibody fragment, single-chain variable fragment, antibody variable fragment, antigen-binding fragment, Fd fragment, fibronectin-derived $10^{th}$ fibronectin type II domain, tenascin type II domain, ankyrin repeat motif domain, low-density-lipoprotein-receptor-derived A-domain, lipocalin, Kunitz domain, Protein-A-derived Z domain, gamma-B crystalline-derived domain, ubiquitin-derived domain, Sac7d-derived polypeptide, Fyn-derived SH2 domain, engineered antibody mimic, and any genetically manipulated counterparts of any of the foregoing that retain binding functionality.

In certain further embodiments of the present invention, the expression library of the method is operable using the protein display method for selecting a specific characteristic selected from the group consisting off bacteriophage display, RNA display, ribosome display, DNA display, bead surface display, virus display, microorganism display, and mammalian cell display.

In certain further embodiments, at least one binding region of the method is capable of binding to a target biomolecule found in physical association with at least one type of malignant cell. In certain further embodiments of the invention, at least one binding region is capable of binding to an extracellular target biomolecule found in physical association with at least one type of malignant cell. In certain further embodiments of the invention, at least one binding region is capable of binding to an intracellular target biomolecule found in physical association with at least one type of malignant cell. A malignant cell includes cells characterized as cancer cells, tumor cells, hyperplastic cells, infected cells, and abnormal cells.

In certain further embodiments of the present invention, the target biomolecule of at least one binding region of the method is selected from the group consisting of: CD20, CD22, CD40, CD79, CD25, CD30, HER2/neu/ErbB2, EGFR, EpCAM, EphB2, prostate-specific membrane antigen, Cripto, CDCP1, endoglin, fibroblast activated protein, Lewis-Y, CD19, CD21, CS1/SLAMF7, CD33, CD52, CD133, EpCAM, CEA, gpA33, mucin, TAG-72, carbonic anhydrase IX, folate binding protein, ganglioside GD2, ganglioside GD3, ganglioside GM2, ganglioside Lewis-Y2, VEGFR, Alpha Vbeta3, Alpha5beta1, ErbB1/EGFR, Erb3, fibroblast growth factor receptor, CD339, c-MET, IGF1R, EphA3, TRAIL-R1, TRAIL-R2, RANKL, FAP, tenascin, CD64, mesothelin, BRCA1, MART-1/MelanA, gp100, tyrosinase, TRP-1, TRP-2, MAGE-1, MAGE-3, GAGE-1/2, BAGE, RAGE, NY-ESO-1, CDK-4, beta-catenin, MUM-1, caspase-8, KIAA0205, HPVE6, SART-1, PRAME, carcinoembryonic antigen, prostate specific antigen, prostate stem cell antigen, human aspartyl (asparaginyl) beta-hydroxylase, EphA2, HER3/ErbB-3, MUC1, MART-1/MelanA, gp100, tyrosinase associated antigen, HPV-E7, Epstein-Barr virus antigen, Bcr-Abl, alpha-fetoprotein antigen, 17-A1, bladder tumor antigen, CD38, CD15, CD23, CD52, CD53, CD88, CD129, CD183, CD191, CD193, CD244, CD294, CD305, C3AR, FceRIa, galectin-9, mrp-14, Siglec-8, Siglec-10, CD49d, CD13, CD44, CD54, CD63, CD69, CD123, CD193, TLR4, FceRIa, IgE, CD107a, CD203c, CD14, CD15, CD33, CD64, CD68, CD50, CD86, CD105, CD115, F4/80, ILT-3, galectin-3, CD11a-c, GITRL, MHC class I molecule, MHC class II molecule, CD284-TLR4, CD107-Mac3, CD120, CD195-CCR5, HLA-DR, CD16/32, CD282-TLR2, CD11c, tumor necrosis factor alpha, and CD123, and any antigenic fragment of any of the foregoing.

In certain further embodiments of the libraries of the present invention, the amino acid sequence of at least one said binding region is derived from a chordate that has been immunized by an antigen or a nucleic acid capable of encoding an antigenic peptide. In certain further embodiments, the immunized chordate is selected from the group consisting of: birds, bovids, camelids, cartilaginous fishes, equines, lagomorphs, primates, rodents, and suiformes. In certain further embodiments, the antigen or antigenic peptide is derived from an amino acid sequence of the protein selected from the group consisting of: CD20, CD22, CD40, CD79, CD25, CD30, HER2/neu/ErbB2, EGFR, EpCAM, EphB2, prostate-specific membrane antigen, Cripto, CDCP1, endoglin, fibroblast activated protein, Lewis-Y, CD19, CD21, CS1/SLAMF7, CD33, CD52, CD133, EpCAM, CEA, gpA33, mucin, TAG-72, carbonic anhydrase IX, folate binding protein, ganglioside GD2, ganglioside GD3, ganglioside GM2, ganglioside Lewis-Y2, VEGFR, Alpha Vbeta3, Alpha5beta1, ErbB1/EGFR, Erb3, fibroblast growth factor receptor, CD339, c-MET, IGF1R, EphA3, TRAIL-R1, TRAIL-R2, RANKL, FAP, tenascin, CD64, mesothelin, BRCA1, MART-1/MelanA, gp100, tyrosinase, TRP-1, TRP-2, MAGE-1, MAGE-3, GAGE-1/2, BAGE, RAGE, NY-ESO-1, CDK-4, beta-catenin, MUM-1, caspase-8, KIAA0205, HPVE6, SART-1, PRAME, carcinoembryonic antigen, prostate specific antigen, prostate stem cell antigen, human aspartyl (asparaginyl) beta-hydroxylase, EphA2, HER3/ErbB-3, MUC1, MART-1/MelanA, gp100, tyrosinase associated antigen, HPV-E7, Epstein-Barr virus antigen, Bcr-Abl, alpha-fetoprotein antigen, 17-A1, bladder tumor antigen, CD38, CD15, CD23, CD52, CD53, CD88, CD129, CD183, CD191, CD193, CD244, CD294, CD305, C3AR, FceRIa, galectin-9, mrp-14, Siglec-8, Siglec-10, CD49d, CD13, CD44, CD54, CD63, CD69, CD123, CD193, TLR4, FceRIa, IgE, CD107a, CD203c, CD14, CD15, CD33, CD64, CD68, CD80, CD86, CD105, CD115, F4/80, ILT-3, galectin-3, CD11a-c, GITRL, MHC class I molecule, MHC class II molecule, CD284-TLR4, CD107-Mac3, CD120, CD195-CCR5, HLA-DR, CD16/32, CD282-TLR2, CD11c, tumor necrosis factor alpha, and CD123, and any antigenic fragment of any of the foregoing.

In certain further embodiments, the ribotoxic region is derived from SEQ ID NOs: 1-14, or any ribotoxic fragment thereof.

In certain further embodiments of the present invention, the ribotoxic region of the library is derived from the amino acid sequence of the A Subunit of at least one member of the Shiga toxin family.

In certain further embodiments, the modified ribotoxic region comprises or consists essentially of SEQ ID NOs: 15-39 or any ribotoxic fragment thereof.

In certain embodiments of the cytotoxic proteins and polypeptides of the present invention, the cytotoxic protein or polypeptide comprises two or more heterologous polypeptide regions, wherein at least one of the two or more regions comprises a ribotoxic region and a different one of the two or more heterologous regions comprises a binding region.

In certain embodiments, the nucleic acids of the present invention encode a cytotoxic protein or polypeptide of the invention. In certain embodiments, the nucleic acids of the present invention encode a cytotoxic protein or polypeptide created or identified using any method of the present invention.

In certain embodiments, the nucleic acids of the present invention are the nucleic acids produced by any method of the invention. In certain further embodiments, the nucleic acid comprises the polynucleotide sequence of any one of SEQ ID NOs: 40-64 or a derivative thereof.

In certain embodiments, the molecular libraries of the present invention are the libraries produced by any method of the invention. In certain further embodiments, the molecular libraries comprise a nucleic acid comprising the polynucleotide sequence of any one of SEQ ID NOs: 40-64.

BRIEF DESCRIPTION OF THE FIGURES

FIG. 2 graphically shows the results of an assay for target biomolecule binding by phage displaying chimeric cytotoxic polypeptides designed with ribotoxic regions mutated to reduce or eliminate ribotoxicity as compared to a fully active ribotoxic region. Phage displaying polypeptides comprising catalytically inactive, mutant, ribotoxic regions showed a 1.7 to 2.9 fold increase of HER2 target binding signal in a phage ELISA assay as compared to phage displaying a polypeptide with an identical binding region but a fully active ribotoxic region.

FIG. 3 is a polypeptide alignment of a portion of the wild-type Shiga-like toxin 1 A Subunit with a spontaneously occurring mutant of a Shiga toxin derived, ribotoxic region recovered during phage display screening of a diverse expression library designed without any reduction in ribotoxicity (SEQ ID NOs: 89-92, respectively, in order of appearance).

FIG. 4 graphically shows that the spontaneously occurring ribotoxin region mutant recovered during phage display screening exhibited greatly attenuated ribosome inhibition as compared to a wild-type ribotoxic polypeptide.

FIG. 5 shows the successful enrichment of phage clones displaying a chimeric polypeptide which binds the selected target biomolecule SLAMF7 within a phage display library designed with mutated ribotoxic regions to reduce or eliminate ribotoxicity via catalytic inactivation.

DETAILED DESCRIPTION

Figure 1:
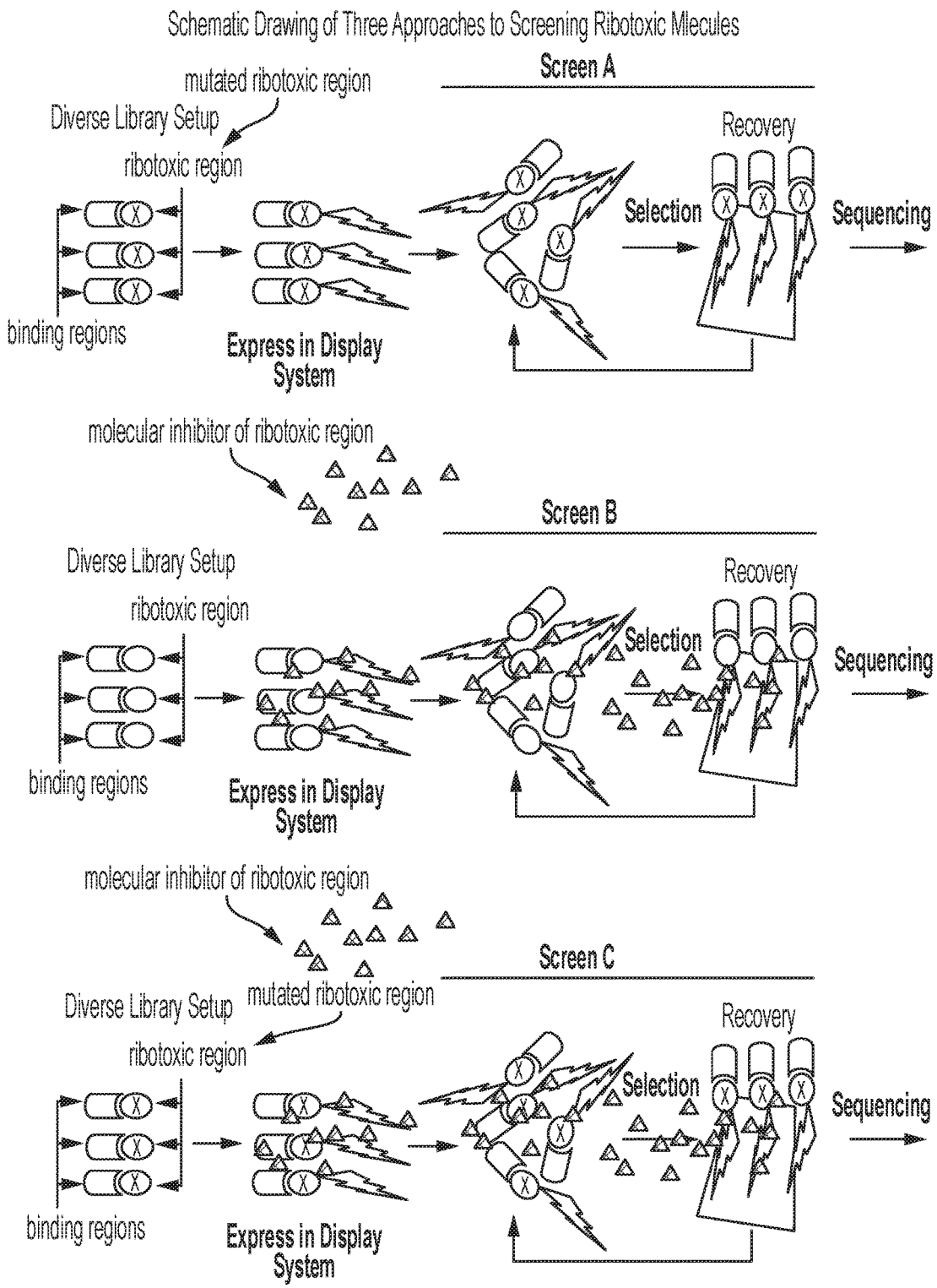
FIG. 1 shows a pictorial representation of three approaches to screening ribotoxic molecules: 1) reduced and/or eliminated ribotoxicity via mutation, 2) reduced and/or eliminated ribotoxicity via the addition of an inhibitor molecule, and both of the first two approaches combined together simultaneously.

The present invention is described more fully hereinafter using illustrative, non-limiting embodiments, and references to the accompanying figures. This invention may, however, be embodied in many different forms and should not be construed as to be limited to the embodiments set forth below. Rather, these embodiments are provided so that this disclosure is thorough and conveys the scope of the invention to those skilled in the art.

In order that the present invention may be more readily understood, certain terms are defined below. Additional definitions may be found within the detailed description of the invention.

As used in the specification and the appended claims, the terms "a," "an" and "the" include both singular and the plural referents unless the context clearly dictates otherwise.

As used in the specification and the appended claims, the term "and/or" when referring to two species, A and B, means at least one of A and B. As used in the specification and the appended claims, the term "and/or" when referring to greater than two species, such as A, B, and C, means at least one of A, B, or C, or at least one of any combination of A, B, or C (with each species in singular or multiple possibility).

Throughout this specification, the word "comprise" or variations such as "comprises" or "comprising" will be understood to imply the inclusion of a stated integer (or components) or group of integers (or components), but not the exclusion of any other integer (or components) or group of integers (or components).

Throughout this specification, the term "including" is used to mean "including but not limited to." "Including" and "including but not limited to" are used interchangeably.

The term "amino acid residue" or "amino acid" includes reference to an amino acid that is incorporated into a protein, polypeptide, or peptide. The term "polypeptide" includes any polymer of amino acids or amino acid residues. The term "polypeptide sequence" refers to a series of amino acids or amino acid residues which physically comprise a polypeptide. A "protein" is a macromolecule comprising one or more polypeptides or polypeptide "chains." A "peptide" is a small polypeptide of sizes less than about 15 to 20 amino acid residues. Unless otherwise indicated, polypeptide and protein sequences disclosed herein are written from left to right representing their order from an amino terminus to a carboxy terminus.

The terms "amino acid," "amino acid residue," or polypeptide sequence include naturally occurring amino acids (including L and D isosteriomers) and, unless otherwise limited, also include known analogs of natural amino acids that can function in a similar manner as naturally occurring amino acids, such as selenocysteine, pyrrolysine, N-formylmethionine, gamma-carboxyglutamate, hydroxyproline-hypusine, pyroglutamic acid, and selenomethionine. The amino acids referred to herein are described by shorthand designations as follows in Table A:

TABLE A

Amino Acid Nomenclature

| Name | 3-letter | 1-letter |
|---|---|---|
| Alanine | Ala | A |
| Arginine | Arg | R |
| Asparagine | Asn | N |
| Aspartic Acid or Aspartate | Asp | D |
| Cysteine | Cys | C |
| Glutamic Acid or Glutamate | Glu | E |
| Glutamine | Gln | Q |
| Glycine | Gly | G |
| Histidine | His | H |
| Isoleucine | Ile | I |
| Leucine | Leu | L |
| Lysine | Lys | K |
| Methionine | Met | M |
| Phenylalanine | Phe | F |
| Proline | Pro | P |
| Serine | Ser | S |
| Threonine | Thr | T |
| Tryptophan | Trp | W |
| Tyrosine | Tyr | Y |
| Valine | Val | V |

The phrase "conservative substitution" with regard to a polypeptide, refers to a change in the amino acid composition of the polypeptide that does not substantially alter the function and structure of the overall polypeptide (see Creighton, *Proteins: Structures and Molecular Properties* (W. H. Freeman and Company, New York (2nd ed., 1992)).

As used herein, the terms "expressed," "expressing," or "expresses," and grammatical variants thereof, refer to translation of a polynucleotide or nucleic acid into a polypeptide or protein. The expressed polypeptides or proteins may remain intracellular, become a component of the cell surface membrane or be secreted into an extracellular space.

As used herein, the symbol "α" is shorthand for an immunoglobulin-type binding region capable of binding to the biomolecule following the symbol. The symbol "α" is used to refer to the functional characteristic of an immunoglobulin-type binding region based on its capability of binding to the biomolecule following the symbol.

The symbol "::" means the polypeptide regions before and after it are physically linked together to form a continuous polypeptide.

For purposes of the present invention, the term "effector" means providing a biological activity, such as cytotoxicity, biological signaling, enzymatic catalysis, subcellular routing, and/or intermolecular binding resulting in the recruitment of a factor(s), and/or allosteric effect(s).

For purposes of the present invention, the phrase "derived from" means that the polypeptide region comprises amino acid sequences originally found in a protein and which may now comprise additions, deletions, truncations, or other alterations relative to the original sequence such that overall function and structure are substantially conserved.

As used herein, the terms "subunit" and "chain" with regard to multimeric toxins, such as, e.g., RIPs or ABx toxins, are used interchangeably.

As used herein, the term "cytotoxic protein" refers to a protein, wherein administration of the cytotoxic protein to a cell causes the death of the cell, commonly through the cytotoxic protein's ability to accomplish cell-surface binding, cellular internalization, and ribosome inactivation.

As used herein, the term "cytotoxic polypeptide" refers to a polypeptide, wherein administration of the cytotoxic polypeptide to a cell causes the death of the cell, commonly through the cytotoxic protein's ability to accomplish cell-surface binding, cellular internalization, and ribosome inactivation.

The term "heterologous" with regard to the two or more polypeptide or peptide regions refers to polypeptide and/or peptide sequences which do not naturally occur together in the same protein.

The phrase "in association with" or "associated with" with regard to a binding region and ribotoxic region components of a polypeptide of the present invention means the binding region and the ribotoxic region are physically linked together, whether by covalent or non-covalent linkages, such as, e.g., embedded or inserted within the polypeptide, fused to the polypeptide, and/or chemically conjugated to the polypeptide.

For purposes of the present invention, a ribotoxic region may exhibit multiple and diverse biological activities. Certain RIP toxins can ADP-ribosylate ribosomal proteins using their adenosine diphosphate-ribosyl (ADPR) transferase activity. Certain RIP toxins, such as e.g. DT and PE, transfer ADP-ribose moieties to diphthamide residues in polypeptides or proteins, in enzymatic reactions which may be assayed using techniques known in the art (see e.g. Collier R, *J Mol Biol* 25: 83-98 (1967); Gill D et al., *Cold Spring Harb Symp Quant Biol* 34: 595-602 (1969); Iglewski B, Kabat D, *Proc Natl Acad Sci USA* 72: 2284-8 (1975)). Certain RIPs can depurinate nucleic acids, polynucleosides, polynucleotides, rRNA, ssDNA, dsDNA, mRNA (and polyA), and viral nucleic acids (Barbieri L et al., *Biochem J* 286: 1-4 (1992); Barbieri L et al., *Nature* 372: 624 (1994); Ling J et al., *FEBS Lett* 345: 143-6 (1994); Barbieri L et al., *Biochem J* 319: 507-13 (1996); Roncuzzi L, Gasperi-Campani A, *FEBS Lett* 392: 16-20 (1996); Stirpe F et al., *FEBS Lett* 382: 309-12 (1996); Barbieri L et al., *Nucleic Acids Res* 25: 518-22 (1997); Wang P, Tumer N, *Nucleic Acids Res* 27: 1900-5 (1999); Barbieri L et al., *Biochim Biophys Acta* 1480: 258-66 (2000); Barbieri L et al., *J Biochem* 128: 883-9 (2000); Bagga S et al., *J Biol Chem* 278: 4813-20 (2003); Picard D et al. *J Biol Chem* 280: 20069-75 (2005)). Some RIPs show antiviral activity and superoxide dismutase activity (Erice A et al., *Antimicrob Agents Chemother* 37: 835-8 (1993); Au T et al., *FEBS Lett* 471: 169-72 (2000); Parikh B, Tumer N, *Mini Rev Med Chem* 4: 523-43 (2004); Sharma N et al., *Plant Physiol* 134: 171-81 (2004)). For example, Shiga toxin catalytic activities include ribosome inactivation, protein synthesis inhibition, N-glycosidase activity, polynucleotide:adenosine glycosidase activity, RNAase activity, and DNAase activity. Ribotoxic catalytic activities may be observed both in vitro and in vivo. Non-limiting examples of assays for ribotoxic region activity measure protein synthesis inhibitory activity, depurination activity, inhibition of cell growth, cytotoxicity, supercoiled DNA relaxation activity, and nuclease activity.

As used herein, a ribotoxic region capable of inactivating a ribosome refers to a level of ribotoxic activity, as measured by an appropriate quantitative assay with reproducibility where the level is greater than zero. An example of an assay for ribosome inactivation is an in vitro assay, such as, e.g., an in vitro translation assay with a readout for the amount of protein synthesized (see e.g. Hovde C et al., *Proc Natl Acad Sci USA* 85: 2568-72 (1988); Wilson B, Collier R, *Curr Top Microbiol Immunol* 175: 27-41 (1992); Ohmura M et al.,

*Microb Pathog* 15: 169-76 (1993); Skinner L, Jackson M, *J Bacteriol* 179: 1368-74 (1997)). A ribotoxic region which exhibits an $IC_{50}$ of 10,000 picomolar (pM) or less is capable of inactivating a ribosome. Another example of an assay for ribosome inactivation is an in vivo assay, such as, e.g., after de novo expression of the ribotoxic region (Deresiewicz R et al., *Biochemistry* 31: 3272-80 (1992); LaPointe, *J Biol Chem* 280: 23310-18 (2005); Di R, *Toxicon* 57: 525-39 (2011)) as measured by the ribotoxic region exhibiting a non-zero level of ribosome inhibition and/or cytotoxicity. Another example of an assay for ribosome inhibition is an in vivo assay where a cell-targeted molecule comprising the ribotoxic region exhibits a non-zero cytotoxicity that is measured using a target positive cell kill assay. In this type of assay, a cell-targeted molecule comprising a Shiga toxin derived, ribotoxic region can exhibit a $CD_{50}$ of 1,000 nanomolar (nM) or less, depending on the cell type and its expression of the appropriate extracellular target biomolecule.

As used herein, a toxin effector function or activity may include, inter alia, promoting cellular internalization, promoting endosome escape, directing intracellular routing to a subcellular compartment, catalytic functions, substrate binding, inducing apoptosis of cell, causing cytostasis, and cytotoxicity.

For purposes of the present invention, the phrase "Shiga toxin effector region" refers to a polypeptide region derived from a Shiga toxin A Subunit of a member of the Shiga toxin family that is capable of exhibiting at least one Shiga toxin function. Shiga toxin functions include, e.g., cell entry, lipid membrane deformation, directing subcellular routing, catalytically inactivating ribosomes, effectuating cytotoxicity, and effectuating cytostatic effects.

Introduction

Despite the power of protein display technologies, their effective use can be hindered when screening libraries comprising toxic components, which might introduce hindrances in the form of unwanted selection biases. Ribotoxic components are capable of exerting detrimental ribosome inactivation effects during screening which introduce strong biological biases toward suppressing ribotoxicity independent of any desirable selectable characteristic. Surprisingly, the Examples herein show that even a protein display method generally considered in vitro may be disrupted by the use of a ribotoxic component within the protein libraries screened. In particular, the screening of libraries comprising ribotoxic polypeptide components can be harmful to the screening system itself resulting in such a strong biological bias that the screen is ineffective (see, Examples, below). The present invention overcomes this problem by screening in the context and/or environment where the activity of a ribotoxic component is temporarily reduced or eliminated.

Although there is demand to apply more statistically powerful screening methods to toxin-derived libraries, in transitioning to more powerful screening techniques, there is the possibility of significant false positive selection and other selection biases that might render the screening ineffective by confounding the efficiency of the process. For example, molecules that have lost their toxic properties through alterations to the molecule or through extremely inefficient production are a significant concern to raising the false positive rate. During phage display screening of toxin-derived protein libraries, two types of false positives have been reported: 1) phage clones that bind to components other than the intended targets in the selection system and 2) phage clones whose displayed protein impart propagation advantages of other phage clones in the library being screened (Vodnik M et al., *Molecules* 16: 790-817 (2011)).

To work around these problems, toxin-based polypeptides have mostly been developed slowly in a piecemeal fashion by screening targeting domains in the absence of any toxin region (Cheung, *Mol Cancer* 9: 28 (2010)). This fragmentary and compartmentalized approach adds the need for additional genetic engineering steps to build the complete chimeric structure, which might then acquire different attributes in terms of cell targeting, cellular processing, and cytotoxicity (Allen T, *Nat Rev Cancer* 2: 750-63 (2002); Pastan I, *Cancer Immunol Immunother* 52: 338-41 (2003); Binz H et al., *Nat Biotechnol* 23: 1257-68 (2005)). In addition, the extra step of completing the structure is an additional inefficiency in the development of the final structure in its cytotoxic form. Furthermore, the production process for producing the final cytotoxic form must be optimized after the extra step of completing the chimeric structure. The approach of developing cytotoxic proteins by either a piecemeal manner or ineffective screens has led to the selection of molecules with less than ideal production and pharmacokinetic properties and has significantly slowed the pace of developing commercially viable cytotoxic fusion proteins (Weldon, *FEBS J* 278: 4683-700 (2011)).

The present invention solves the need for quicker, non-piecemeal screening approaches and solves the problem of small-scale, ineffective, and/or biased screening by providing methods of screening, selecting, and identifying cytotoxic proteins and polypeptides based on the interim reduction or elimination of ribotoxicity. The methods of the invention allow for the one step selection of chimeric cytotoxic proteins and polypeptides in the context of a completely chimeric molecule while minimizing unwanted selection biases caused by the presence of ribotoxicities. Thus, polypeptides which have desired expression, stability, and other production characteristics in the context of the final chimeric molecule can be identified in a single screening step simultaneously while selecting for other desired characteristics, such as, e.g., target molecule binding affinity, target cell binding affinity, and/or target cell internalization. The present invention enables more efficient explorations of inter-region interactions between binding regions and toxin regions while screening. In addition, the present invention limits the amount of post-screening molecular engineering required because multiple characteristics may be evaluated simultaneously, such as, e.g., production quality and assay selectable characteristics.

In certain methods of the invention involve screening libraries of diverse nucleic acids encoding fusion polypeptides comprising binding regions and either ribotoxic regions or modified ribotoxic regions in order to identify a sequence(s) of a selected fusion polypeptide for the discovery and construction of a chimeric, cytotoxic, protein or polypeptide with a desired characteristic.

The methods of the present invention provide for efficient, effective, and powerful screening, such as by using protein display technologies which enabling the screening of relatively large and diverse polypeptide libraries. The methods of the present invention allow for statistically powerful one-step screening of chimeric molecules comprising ribotoxic polypeptide regions using protein display methods such as, e.g., cell-surface display, RNA display, phage display, protein-DNA linkage display, bead surface display, ribosome display, and virus display. The screening methods of the present invention are more effective because they avoid unwanted selection biases resulting from the presence of screen-disrupting ribotoxicities.

The reduction or elimination of ribotoxicity may be accomplished in three ways: 1) by using a non-ribotoxic form of the toxin region caused by one or more mutations, 2) by performing the screening and/or selecting in the presence of an inhibitor molecule of the appropriate toxin region, or 3) combining both 1 and 2. Polypeptide sequences identified by methods of the present invention using non-ribotoxic libraries may be readily converted into more ribotoxic and/or fully ribotoxic polypeptide sequences. These two general approaches, whether used in isolation or combined, enable the more efficient discovery of chimeric, cytotoxic proteins and polypeptides exhibiting desired characteristics, such as, e.g., characteristics indicative of a safe and effective therapeutic.

I. The General Structure of the Cytotoxic Proteins and Polypeptides of the Invention The present invention provides methods of screening, selecting and identifying cytotoxic proteins and polypeptides, such as, e.g., immunotoxins, ligand-toxin fusions, immuno-RNases, and toxin variants comprising synthetic peptide, targeting domains.

As referred to herein, a "cytotoxic protein" or "cytotoxic polypeptide" comprises a 1) binding region comprising a polypeptide and capable of binding at least one target biomolecule, and 2) a ribotoxic region comprising a polypeptide and capable of catalytically inactivating a ribosome. Cytotoxic proteins and polypeptides of the present invention are chimeric in that the binding region is heterologous to the ribotoxic region, meaning that these two regions do not naturally occur together in the same naturally occurring protein.

Generally, immunotoxins, ligand-toxin fusion proteins, and immune-RNases are chimeric proteins that combine a cell surface binding region for cell targeting with a toxin region. Most existing immunotoxins have been engineered from an immunoglobulin-based targeting module fused to a polypeptide region from a bacterial toxin, such as, e.g., DT or PE, or a RIP naturally found in plants, such as ricin, saporin, and gelonin (see Table 1). Ligand-toxin fusion proteins are similar to immunotoxins except the targeting module is derived from a naturally occurring moiety capable of binding a naturally occurring receptor. Immuno-RNases comprise RNase enzymatic domains and may comprise targeting modules of either of the former, but typically comprising immunoglobulin domains. For therapeutic uses, immunotoxins, ligand-toxin fusion proteins, and immuno-RNases all depend on cell targeting, cellular internalization and efficient release into the cytosol in order to kill target cells efficiently and at dosages relatively non-toxic to untargeted cells.

TABLE 1

Exemplary Protein Toxins with Ribotoxic Catalytic Domains

| Protein Toxin | Substrate - Exemplary Effect |
| --- | --- |
| Abrins | SRL - blocks EF2 binding and translocation |
| Aspf1 | SRL - blocks EF1/EF2 binding and translocation |
| Bouganin | SRL - blocks EF2 binding and translocation |
| Bryodins | SRL - blocks EF2 binding and translocation |
| Cholix toxin | EF2 - blocks translocation |
| Cinnamomin | SRL - blocks EF2 binding and translocation |
| Claudin | SRL - blocks EF2 binding and translocation |
| Clavin | SRL - blocks EF1/EF2 binding and translocation |
| Dianthins | SRL - blocks EF2 binding and translocation |
| Diphtheria toxins | EF2 - blocks translocation |
| Ebulins | SRL - blocks EF2 binding and translocation |
| Gelonin | SRL - blocks EF2 binding and translocation |

TABLE 1-continued

Exemplary Protein Toxins with Ribotoxic Catalytic Domains

| Protein Toxin | Substrate - Exemplary Effect |
| --- | --- |
| Gigantin | SRL - blocks EF1/EF2 binding and translocation |
| Maize RIPs | SRL - blocks EF2 binding and translocation |
| Mitogillin | SRL - blocks EF1/EF2 binding and translocation |
| Nigrins | SRL - blocks EF2 binding and translocation |
| PD-Ls | SRL - blocks EF2 binding and translocation |
| PAPs | SRL - blocks EF2 binding and translocation |
| *Pseudomonas* toxins | EF2 - blocks translocation |
| Pulchellin | SRL - blocks EF2 binding and translocation |
| Restrictocin | SRL - blocks EF1/EF2 binding and translocation |
| Ricins | SRL - blocks EF2 binding and translocation |
| Saporins | SRL - blocks EF2 binding and translocation |
| Sarcins | SRL - blocks EF1/EF2 binding and translocation |
| Shiga toxins | SRL - blocks EF2 binding and translocation |
| Trichosanthins | SRL - blocks EF2 binding and translocation | a. Ribotoxic Region for Effectuating Cell Killing

With regard to the claimed invention, the phrases "ribotoxic region" and "modified ribotoxic region" refer to a polypeptide derived from proteins, including naturally occurring toxins and synthetic toxins, that are capable of effectuating ribosome inactivation in vitro, protein synthesis inhibition in vitro and/or in vivo, cytotoxicity, and/or cytostasis. Commonly, ribotoxic regions are enzymatically active domains derived from naturally occurring protein toxins or toxin-like structures which are altered or engineered by human intervention (see e.g. Newton D et al., *Blood* 97: 528-35 (2001); De Lorenzo C et al., *FEBS Lett* 581: 296-300 (2007); De Lorenzo C, D'Alessio G, *Curr Pharm Biotechnol* 9: 210-4 (2008); Menzel C et al., *Blood* 111: 3830-7 (2008)). However, other polypeptides, such as, e.g., naturally occurring enzymatic domains not natively present in a toxin or synthetic polypeptide, are within the scope of that term as used herein. Thus, ribotoxic toxin effector polypeptides may be derived from synthetic or engineered protein constructs with increased or decreased ribotoxicity, and/or naturally occurring proteins that have been otherwise altered to have a non-native characteristic, such as, e.g. increased stability, optimized expression in a laboratory species or cell line, improved solubility, improved pharmacokinetic properties, improved pharmacodynamic properties, and/or reduced antigenicity and/or immunogenicity.

The ribotoxic regions and modified ribotoxic regions of the chimeric polypeptides of the invention may be derived from ribotoxic domains of proteins from diverse phyla, such as, e.g., algae, bacteria, fungi, plants, and animals. For example, polypeptides derived from various toxins have been linked or fused to immunoglobulin domains, receptor ligands, or randomized peptides through chemical conjugation or recombinant protein engineering with the hope of creating cell-type-specific cytotoxic therapeutics (see e.g. Pastan I et al., *Annu Rev Biochem* 61: 331-54 (1992); Foss F et al., *Curr Top Microbiol Immunol* 234: 63-81 (1998); Olsnes S, *Toxicon* 44: 361-70 (2004); Pastan I, et al., *Nat Rev Cancer* 6: 559-65 (2006); Lacadena J et al., *FEMS Microbiol Rev* 31: 212-37 (2007); de Virgilio M et al., *Toxins* 2: 2699-737 (2011); Walsh M, *Virulence* 4: 774-84 (2013); Weidle U et al., *Cancer Genomics Proteomics* 11: 25-38 (2014)).

Ribotoxic regions and modified ribotoxic regions of the invention may be derived from the catalytic domains of members of the Ribosome Inactivating Protein (RIP) Superfamily of protein ribotoxins (de Virgilio M et al., *Toxins* 2: 2699-737 (2011); Lapadula W et al., *PLoS ONE* 8: e72825

(2013); Walsh M, *Virulence* 4: 774-84 (2013)). RIPs are ribotoxic proteins expressed in algae, bacteria, fungi, and plants which are often potent inhibitors of eukaryotic and prokaryotic protein synthesis at sub-stoichiometric concentrations (see Stirpe, F, *Biochem J* 202: 279-80 (1982)). Various RIPs are considered promising sources for toxin effector polypeptide sequences for use in therapeutics for treating cancers (see Pastan I, et al., *Nat Rev Cancer* 6: 559-65 (2006); Fracasso G et al., *Ribosome-inactivating protein-containing conjugates for therapeutic use*, Toxic Plant Proteins 18, pp. 225-63 (Eds. Lord J, Hartley, M. Berlin, Heidelberg: Springer-Verlag, 2010); de Virgilio M et al., *Toxins* 2: 2699-737 (2011); Puri M et al., *Drug Discov Today* 17: 774-83 (2012); Walsh M, *Virulence* 4: 774-84 (2013)).

The most commonly used ribotoxins in recombinant cytotoxic polypeptides include DT, PE, ricin, α-sarcin, saporin, and gelonin (see Shapira A, Benhar I, *Toxins* 2: 2519-83 (2010); Yu C et al., *Cancer Res* 69: 8987-95 (2009); Fuenmayor J, Montaño R, *Cancers* 3: 3370-93 (2011); Weldon, *FEBS J* 278: 4683-700 (2011); Carreras-Sangrá N et al., *Protein Eng Des Sel* 25: 425-35 (2012); Lyu M et al., *Methods Enzymol* 502: 167-214 (2012); Antignani, *Toxins* 5: 1486-502 (2013); Lin H et al., *Anticancer Agents Med Chem* 13: 1259-66 (2013); Polito L et al., *Toxins* 5: 1698-722 (2013); Walsh M, *Virulence* 4: 774-84 (2013)). These ribotoxins are generally classified as ribosome inactivating proteins (RIPs) and share a general cytotoxic mechanism of inactivating eukaryotic ribosomes by attacking the sarcin-ricin loop (SRL) or proteins required for ribosome function which bind to the SRL.

The SRL structure is highly conserved between the three phylogenetic groups, Archaea, Bacteria and Eukarya, such that both prokaryotic and eukaryotic ribosomes share a SRL ribosomal structure (Gutell R et al., *Nucleic Acids Res* 21: 3055-74 (1993); Szewczak A, Moore P, *J Mol Biol* 247: 81-98 (1995); Glück A, Wool I, *J Mol Biol* 256: 838-48 (1996); Seggerson K, Moore P, *RNA* 4: 1203-15 (1998); Correll C et al., *J Mol Biol* 292: 275-87 (1999)). The SRL of various species from diverse phyla can be superimposed onto a crystal structure electron density map with high precision (Ban N et al., *Science* 11: 905-20 (2000); Gabashvili I et al., *Cell* 100: 537-49 (2000)). The SRL is the largest universally conserved ribosomal sequence which forms a conserved secondary structure vital to the ribosome function of translocation via the cooperation of elongation factors, such as EF-Tu, EF-G, EF1, and EF2 (Voorhees R et al., *Science* 330: 835-8 (2010); Shi X et al., *J Mol Biol* 419: 125-38 (2012); Chen K et al., *PLoS One* 8: e66446 (2013)). The SRL (sarcin-ricin loop) was named for being the shared target of the fungal ribotoxin sarcin and the plant type II RIP ricin.

The RIP Superfamily includes RIPs, fungal ribotoxins, and bacterial ribotoxins that interfere with ribosome translocation functions (see e.g. Table 1, supra; Brigotti M et al., *Biochem J* 257: 723-7 (1989)). Most RIPs, like abrin, gelonin, ricin, and saporin, irreversibly depurinate a specific adenine in the universally conserved sarcin/ricin loop (SRL) of the large rRNAs of ribosomes (e.g. A4324 in animals, A3027 in fungi, and A2660 in prokaryotes). Most fungal ribotoxins, like α-sarcin, irreversibly cleave a specific bond in the SRL (e.g. the bond between G4325 and A4326 in animals, G3028 and A3029 in fungi, and G2661 and A2662 in prokaryotes) to catalytically inhibit protein synthesis by damaging ribosomes (Martínez-Ruiz A et al., *Toxicon* 37: 1549-63 (1999); Lacadena J et al., *FEMS Microbiol Rev* 31: 212-37 (2007); Tan Q et al., *J Biotechnol* 139: 156-62 (2009)). The bacterial protein ribotoxins cholix toxin, diphtheria toxin (DT), and *Pseudomonas* exotoxin A (PE) are classified in the RIP Superfamily because they can inhibit protein synthesis by catalytically damaging ribosome function and induce apoptosis efficiently with only a few toxin molecules.

Most toxins of the RIP Superfamily are naturally adapted to enter cells and specifically inactivate ribosomes (Lacadena J et al., *FEMS Microbiol Rev* 31: 212-37 (2007) de Virgilio M et al., *Toxins* 2: 2699-737 (2011); Walsh M, *Virulence* 4: 774-84 (2013)). Once inside a cell, RIPs, fungal ribotoxins and other bacterial toxins can be very cytotoxic. The potency of some members of the RIP Superfamily is reported to be extremely high such that as little as one toxin molecule can kill a cell (Yamaizumi M et al., *Cell* 15: 245-50 (1978); Eiklid K et al., *Exp Cell Res* 126: 321-6 (1980); Lamy et al., *Targeted Diagn Ther* 7: 237-58 (1992); Potala S et al., *Drug Discov Today* 13: 807-15 (2008); Antignani A, Fitzgerald D, *Toxins* 5: 1486-502 (2013)). A RIP is capable of permanently cripple one ribosome after another within the same cell at a rate of approximately 1,500 ribosomes per minute (Endo Y, Tsurugi K, *Eur J Biochem* 171: 45-50 (1988); Endo Y et al., *J Biol Chem* 263: 8735-9 (1988)). It is believed that a single RIP toxin molecule can irreversibly inactive 300 ribosomes in 35 minutes and is sufficient to kill a cancer cell (Weldon J, Pastan I, *FEBS J* 278: 4683-700 (2011)).

RIPs are defined by one common feature, the ability to inhibit translation in vitro by damaging the ribosome via ribosomal RNA (rRNA) N-glycosidase activity. By 2013, over one hundred RIPs had been described (Walsh M, *Virulence* 4: 774-84 (2013)). Most RIPs depurinate a specific adenine residue in the universally conserved sarcin/ricin loop (SRL) of the large rRNA of both eukaryotic and prokaryotic ribosomes. The highest number of RIPs has been found in the following families: Caryophyllaceae, Sambucaceae, Cucurbitaceae, Euphorbiaceae, Phytoleccaceae, and Poaceae.

Members of the RIP family are categorized into at least three classes based on their structures. Type I RIPs, e.g. gelonin, luffins, PAP, saporins and trichosanthins, are monomeric proteins comprising an enzymatic domain and lacking an associated targeting domain. Type II RIPs, e.g. abrin, ricin, Shiga toxins, are multi-subunit, heteromeric proteins with an enzymatic A subunit and a targeting B subunit(s) typical of binary ABx toxins (Ho M, et al., *Proc Natl Acad Sci USA* 106: 20276-81 (2009)). Type II RIPs, e.g. barley JIP60 RIP and maize b-32 RIP, are synthesized as proenzymes that require extensive proteolytic processing for activation (Peumans W et al., *FASEB J* 15: 1493-1506 (2001); Mak A et al., *Nucleic Acids Res* 35: 6259-67 (2007)).

Although there is low sequence homology (<50% identity) between members of the RIP family, their catalytic domains share conserved tertiary structures which are superimposable such that key residues involved in the depurination of the ribosome are identifiable (de Virgilio M et al., *Toxins* 2: 2699-737 (2011); Walsh M, *Virulence* 4: 774-84 (2013)). For example, the catalytic domains of ricin and Shiga toxin are superimposable using crystallographic data despite the 18% sequence identity of their A-chain subunits (Fraser M et al., *Nat Struct Biol* 1: 59-64 (1994)).

Immunotoxins have been created using many ribotoxins and ribotoxic regions such as, e.g., gelonin, saporin, pokeweed antiviral protein (PAP), bryodin, bouganin, momordin, dianthin, momorcochin, trichokirin, luffin, restrictocin, mitogillin, alpha-sarcin, Onconase®, and pancreatic ribonucleases. In particular, potently cytotoxic immunotoxins have been generated using polypeptides derived from the RIPs: ricin, gelonin, saporin, momordin, and PAPs (Pasqualucci L et al., *Haematologica* 80: 546-56 (1995)).

A subgroup of the RIP Superfamily is the Shiga toxin family, a group of type II RIPs found in bacteria. Shiga toxins were shown to behave like prototypical type II RIPs are considered equivalent to ricin and abrin (Walsh M, *Virulence* 4: 774-84 (2013)).

The Shiga toxin family of related protein toxins, notably toxins isolated from *S. dysenteriae* and *E. coli*, is composed of various naturally occurring toxins that are structurally and functionally related (Johannes L, Römer W, *Nat Rev Microbiol* 8: 105-16 (2010)). For example, the Shiga toxin family encompasses true Shiga toxin (Stx) isolated from *S. dysenteriae* serotype 1, Shiga-like toxin 1 variants (SLT1 or Stx1 or SLT-1 or Slt-1) isolated from serotypes of enterohemorrhagic *E. coli*, and Shiga-like toxin 2 variants (SLT2 or Stx2 or SLT-2) isolated from serotypes of enterohemorrhagic *E. coli*. SLT1 differs by only one residue from Stx, and both have been referred to as Verocytotoxins or Verotoxins (VTs) (O'Brien, *Curr Top Microbiol Immunol* 180: 65-94 (1992)). Although SLT1 and SLT2 variants are only about 53-60% similar to each other at the amino acid sequence level, they share mechanisms of enzymatic activity and cytotoxicity common to the members of the Shiga toxin family (Johannes, *Nat Rev Microbiol* 8: 105-16 (2010)). Over 39 different Shiga toxins have been described, such as the defined subtypes Stx1a, Stx1c, Stx1d, and Stx2a-g (Scheutz F et al., *J Clin Microbiol* 50: 2951-63 (2012)). Members of the Shiga toxin family are not naturally restricted to any bacterial species because Shiga-toxin-encoding genes can spread among bacterial species via horizontal gene transfer (Strauch E et al., *Infect Immun* 69: 7588-95 (2001); Zhaxybayeva O, Doolittle W, *Curr Biol* 21: R242-6 (2011)). Once a Shiga toxin encoding polynucleotide enters a new subspecies or species, the Shiga toxin amino acid sequence is presumed to be capable of developing slight sequence variations due to genetic drift and/or selective pressure while still maintaining a mechanism of cytotoxicity common to members of the Shiga toxin family (see Scheutz, *J Clin Microbiol* 50: 2951-63 (2012)).

A subfamily of the RIP Superfamily comprises the fungal ribotoxins. The best characterized fungal ribotoxins are α-sarcin, Aspf1, mitogillin, and restrictocin. Although many ribotoxins share high sequence similarity (~85%), some ribotoxins, e.g. Hirsutelin A (HtA), have very low sequence similarity to the majority of ribotoxins. In addition, certain fungal ribotoxins inactivate ribosomes using disparate mechanisms, such as, e.g., Burkholderia lethal factor 1 (BLF1) (Walsh M, *Virulence* 4: 774-84 (2013)).

Members of the RIP Superfamily are not only capable of inactivating eukaryotic ribosomes but can also inactivate prokaryotic ribosomes and cleave naked nucleic acids as well (Lacadena J et al., *FEMS Microbiol Rev* 31: 212-37 (2007); de Virgilio M et al., *Toxins* 2: 2699-737 (2010); Garcia-Ortega L et al., *Nucleic Acids Res* 38: 4108-19 (2010)). For example, sarcin was shown to inactivate both prokaryotic and eukaryotic ribosomes of a variety of species (Schindler D, Davies J, *Nucleic Acids Res* 4: 1097-110 (1977); Turnay J et al., *Mol Cell Biochem* 122: 39-47 (1993); Endo Y et al., *Nucleic Acids Symp Ser* 29: 165-6 (1993)).

Many RIPs have been shown to inactivate prokaryotic ribosomes in vitro (Suh J et al., *Biochem* 37: 9394-8 (1998); Nagasawa Y et al., *Phytochemistry* 69: 1653-60 (2008)). Furthermore, some RIPs have been shown to be cytotoxic to bacteria in addition to eukaryotic cells (Suh J et al., *Biochem* 37: 9394-8 (1998)). In particular, the A Subunit of Shiga toxin exhibited equivalent cytotoxicities to eukaryotic and prokaryotic cells (Skinner L et al., *Microbial Pathog* 24: 117-22 (1998); Suh J et al., *Biochem* 37: 9394-8 (1998)).

Different RIPs display different affinities for different ribosomal substrates (Korennykh A et al., *Nat Struct Mol Biol* 13: 436-43 (2006); Stirpe F, Battelli M, *Cell Mol Life Sci* 63: 1850-66 (2006); Korennykh A et al., *Biochem* 46: 12744-56 (2007); Lacadena J et al., *FEMS Microbiol Rev* 31: 212-37 (2007); de Virgilio M et al., *Toxins* 2: 2699-737 (2010)). For example, the A-chain of ricin is much more active against eukaryotic ribosomes versus prokaryotic ribosomes; however, the ricin A-chain can depurinate prokaryotic 23S rRNA in vitro (Endo Y, Tsurugi K, *J Biol Chem* 263: 8735-9 (1998)). In addition, some RIPs have been shown to be more active to certain eukaryotic cells versus others (Olmo N et al., *Eur J Biochem* 268:2113-23 (2001)).

RIPs may be engineered to alter their relative ribosomal affinities. RIPs may be engineered to inactivate a ribosome type it does not normal show activity towards. For example, a wild-type karasurin-A depurinates eukaryotic ribosomes but not prokaryotic ribosomes. Depurination activity toward prokaryotic ribosomes was conferred to a synthetic variant of karasurin-A by substituting a 27 amino acid domain from another RIP with such activity (Nagasawa Y et al., *Phytochemistry* 69: 1653-60 (2008)). Alternatively, RIPs may be engineered to no longer inactivate a ribosome type it normal depurinates. For example, a wild-type PAP depurinates both prokaryotic and eukaryotic ribosomes but an engineered variant with a 27 amino acid domain swap from another RIP limited its activity to only eukaryotic ribosomes (Nagasawa Y et al., *Phytochemistry* 69: 1653-60 (2008)).

Ribotoxins and RIPs can cleave naked nucleic acids in vitro. More than fifty different RIPs have been shown to exhibit ribonucleolytic activity in vitro towards various nucleic acids, such as, e.g., rRNA, DNA, viral RNA, and poly(A) RNA (see Barbieri L et al., *Nature* 372: 624 (1994); Roncuzzi L, Gasperi-Campani A, *FEBS Lett* 392: 16-20 (1996); Barbieri L et al., *Nucleic Acid Res* 25: 518-22 (1997); Nicolas E et al., *J Biol Chem* 273: 17216-20 (1998); Barbieri L et al., *J Biochem* 128: 883-9 (2000); Hudak K et al., *RNA* 6: 369-80 (2000); Hwu L et al., *J Biomed Sci* 7: 420-8 (2000); Nicolas E et al., *J Biol Chem* 275: 31399-406 (2000); Fermani S et al., *J Struct Biol* 168: 278-87 (2009); Wang S et al., *Appl Microbiol Biotechnol* 96: 939-50 (2012); Wang S et al., *Protein Pept Lett* 20: 1257-63 (2013); Wong Y et al., *PLoS One* 7: e49608 (2012); Meng Y et al., *PLoS One* 9: e101998 (2014)).

In addition, the enzymatic domains of various RNases may be engineered as components of cell killing therapeutic molecules. For example, nontoxic RNases when fused to targeting domains are capable of 1) cleaving rRNAs, mRNAs, tRNAs; 2) inhibiting cell growth and/or 3) killing cells (see Newton D et al., *J Biol Chem* 269: 739-45 (1994); Newton D et al., *J Immunol Meth* 231: 159-67 (1999); Yoon J et al., *Life Sci* 64: 1435-45 (1999); Hugh M et al., *Cancer Res* 61: 8737-42 (2001); Newton D et al., *Blood* 97: 528-35 (2001); Krauss J et al., *Biochem Biophys Res Commun* 331: 595-602 (2005); De Lorenzo C et al., *FEBS Lett* 581: 296-300 (2007); Lacadena J et al., *FEMS Microbiol Rev* 31: 212-37 (2007); De Lorenzo C, D'Alessio G, *Curr Pharm Biotechnol* 9: 210-4 (2008); Menzel C et al., *Blood* 111: 3830-7 (2008); Riccio G et al., *J Immunother* 31: 440-5 (2008)). Argonaute enzymatic domains or hybrid enzymatic domains composed of fungal ribotoxins and argonaute sequences may be engineered for ribosome inactivation (see Pichinuk E, Wreschner D, *Protein Sci* 19: 1272-8 (2010)). Examples of RNases with enzymatic domains useful as ribotoxic regions include bacterial RNases, such as, e.g., binase, amphibian RNases, such as e.g., ranpirnase and Onconase®, and mammalian RNases, such as, e.g., bovine semen RNase and the human RNases: RNase2, RNase3, and RNase5 (Newton D et al., *J Biol Chem* 269: 739-45 (1994); Netwon D et al., *J Immunol Meth* 231: 159-67 (1999); Yoon J et al., *Life Sci* 64: 1435-45 (1999); Hugh M et al., *Cancer Res* 61: 8737-42 (2001); Makarov A, Ilinskaya N, *FEBS Lett* 540: 15-20 (2003)).

Many different toxins are contemplated within the scope of the present invention to be utilized for sources of ribotoxic regions, modified ribotoxic regions, and toxin templates. In certain embodiments of the present invention, the ribotoxic region and/or modified ribotoxic region is derived from a member of the RIP Superfamily which includes RIPs, fungal ribotoxins, and bacterial ribotoxins, such as, e.g., cholix toxin, DT, and PE. In certain embodiments of the present invention, the ribotoxic region and/or modified ribotoxic region is derived from a nontoxic RNase. In certain embodiments of the present invention, the ribotoxic region and/or modified ribotoxic region is derived from a toxin selected from the group consisting of: abrins, agrostin, amarandins, amaranthin, Amaranthus antiviral/RIP, angiogenin, *A. patens* RIPs, Articulatin D, asparins, aspergillin, Aspf1, balsamin, *B. hispida* RIP, bouganin, *Bougainvillea× buttiana* antiviral protein1, benincasins, bouganin, *B. rubra* RIPs, bryodins (e.g. bryodin 1, bryodin 2), *B. spectabilis* RIPs, *B. vulgaris* RIPs, *C. album* RIPs, camphorin, *C. aculeatum*-systemic resistance inducing protein, *C. cristata* RIPs, *C. figarei* RIPs, charantin, charybdin, cinnamomin, clavin, *C. moschata* RIP, cochinin B, colocins, crotins, cucurmosin, curcins, *Dianthus* spp. RIPs, *Corynebacterium* spp. diphtheria toxins (diphtheria toxins in *C. ulcerans, C. omega, C. pseudotuberculosis*), dodecandrins, ebulins, ebulitins, *E. hyemalis* RIPs, ecuserratins, enutirucallin, flammin, flammulin, foetidissimin, gelonin, gigantin, gypsophilin, *H. crepitans* RIPs, Heteropelalin, hispin, hirsutellin A, *H. orientalis* RIPs, *H. vulgare* RIPs, hypsin, insularin, *I. hollandica* RIPs, lagenin, lamjapin, lanceolin, *L. cylindrical* RIPs, luffacylin, luffaculin, luffagulin, luffins, *L. usitatissimum* RIPs, lychnin, lyophyllin, manutins, marmorin, mapalmin, *M. charantia* lectin, *M. crystallinum* RIPs, melonin, mexin, *Mirabilis* spp. RIPs, mitogillin, modeccins, MORs, *Mormordica* spp. RIPs, momorsgrovin, moschatin, musarmins, *N. tabacum* RIPs, nigrins, nigritins, ocymoidin, pachyerosin, *P. californicum* lectin, pepocin, petroglaucin, petrograndin, *Phytolacca* spp. RIPs (e.g. *P. dioica* RIPs PD-L1, PD-L2, PD-L3, PD-L4), pisavin, pleuturegin, Pluturegin, *A. thaliana* pectin methyl transferase (PME), *P. multiforum* RIPs, pokeweed antiviral protein (PAP), porrectin, *Aeromonas* spp. *Pseudomonas* toxins (*A. hydrophila pseudomonas*-like toxin), pulchellin, quinqueginsin, *R. communis* agglutinins, restrictocin, ricins, riproximin, saporins, sarcins, sativin, *S. cereale* RIPs, sechiumin, Shiga toxin, Shiga-like toxins, sieboldin b, *S. nigra* RIPs (e.g. *S. nigra* agglutinins I-V), *S. ocymoides* RIPs, *Spinacia oleracea* protein, stellarin, stenodactylin, texanin, tricholin, *Trichosanthes* spp. RIPs (e.g. karasurins, kirilowins, trichoanguin, trichokirins, trichosanthins, TYchi), *Triticum* spp. RIPs, *V. album* RIPs, velin, velutin, verotoxins, *V. hispanica* RIPs, vircumin, volkensin, *V. volvacea* RIPs, Volvarin, Yucca leaf protein, *Z. diploperennis* RIPs, *Z. mays* RIPs, and any functional fragment of any of the foregoing. However, any polypeptide that enzymatically inhibits ribosome function in vitro is anticipated to function within the scope of the presently claimed methods, libraries, chimeric molecules, and fusion polypeptides for screening molecular libraries in order to identify recombinant, ribotoxic proteins and polypeptides.

B. Binding Regions for Targeting Specificity

Cytotoxic proteins and polypeptides of the present invention comprise a binding region capable of specifically binding a target biomolecule. In certain embodiments, the binding region of a cytotoxic protein or polypeptide of the invention comprises a peptide or polypeptide region capable of binding specifically to a target biomolecule. The design of the binding region for targeting is important to engineering a chimeric toxin therapeutic with cytotoxic specificity, such as, e.g., by targeting the cytotoxicity to specific target cells. Commonly, target biomolecule are chosen which may be found physically-coupled to the surface of a cell type of interest, such as, e.g., a cancer cell, tumor cell, plasma cell, infected cell, or host cell harboring an intracellular pathogen. However, target biomolecules may also be found inside cells of interest and thus represent intracellular targets. Binding regions are functionally defined by their ability to bind to target biomolecules.

The binding region of the polypeptides of the present invention may comprise a peptide or polypeptide region. The binding region may comprise one or more various peptidic or polypeptide moieties, such as, e.g., randomly generated peptide sequences, naturally occurring ligands or derivatives thereof, immunoglobulin derived domains, synthetically engineered scaffolds as alternatives to immunoglobulin domains, and the like. The use of proteinaceous binding regions in the cytotoxic polypeptides of the invention may allow for certain cytotoxic polypeptides of the invention to each be represented by a single continuous chain of amino acid residues.

The binding region of the polypeptides of the present invention may comprise a binding region which overlaps or is contained within a ribotoxic region. For example, various toxin polypeptide backbones can tolerate the replacement with and/or insertion of amino acid residue stretches representing peptides in certain positions without significantly perturbing ribotoxic activities (see e.g. US 2013/0196928 A1; US 2007/0298434 A1). By screening libraries comprising ribotoxic regions with highly degenerate peptide replacements and/or insertions, specific peptide inserts or replacements may be identified which serve as a binding region of a molecule of the present invention. This approach can generate binding regions comprised within ribotoxic regions and/or fused to ribotoxic regions.

There are numerous binding regions known in the art that are useful for targeting polypeptides to specific cell-types via their binding characteristics, such as ligands, monoclonal antibodies, engineered antibody derivatives, and engineered alternatives to antibodies.

According to one specific, but non-limiting aspect, the binding region of the cytotoxic protein or polypeptide of the present invention comprises a naturally occurring ligand or derivative thereof that retains binding functionality to a target biomolecule, commonly a cell surface receptor. For example, various cytokines, growth factors, and hormones known in the art may be used to target the cytotoxic protein or polypeptide to the cell-surface of specific cell types expressing a cognate cytokine receptor, growth factor receptor, or hormone receptor. Certain non-limiting examples of ligands include (alternative names are indicated in parentheses) B-cell activating factors (BAFFs, APRIL), colony stimulating factors (CSFs), epidermal growth factors (EGFs), fibroblast growth factors (FGFs), vascular endothelial growth factors (VEGFs), insulin-like growth factors (IGFs), interferons, interleukins (such as IL-2, IL-6, and IL-23), nerve growth factors (NGFs), platelet derived growth factors, transforming growth factors (TGFs), and tumor necrosis factors (TNFs).

According to certain other embodiments, the binding region comprises a synthetic ligand capable of binding a target biomolecule. One non-limiting example is antagonists to cytotoxic T-lymphocyte antigen 4 (CTLA-4).

According to one specific, but non-limiting aspect, the binding region may comprise an immunoglobulin-type binding region. The term "immunoglobulin-type binding region" as used herein refers to a polypeptide region capable of binding one or more target biomolecules, such as an antigen or epitope. Binding regions may be functionally defined by their ability to bind to target molecules. Immunoglobulin-type binding regions are commonly derived from antibody or antibody-like structures; however, alternative scaffolds from other sources are contemplated within the scope of the term.

Immunoglobulin (Ig) proteins have a structural domain known as an Ig domain. Ig domains range in length from about 70-110 amino acid residues and possess a characteristic Ig-fold, in which typically 7 to 9 antiparallel beta strands arrange into two beta sheets which form a sandwich-like structure. The Ig fold is stabilized by hydrophobic amino acid interactions on inner surfaces of the sandwich and highly conserved disulfide bonds between cysteine residues in the strands. Ig domains may be variable (IgV or V-set), constant (IgC or C-set) or intermediate (IgI or I-set). Some Ig domains may be associated with a complementarity determining region (CDR) which is important for the specificity of antibodies binding to their epitopes. Ig-like domains are also found in non-immunoglobulin proteins and are classified on that basis as members of the Ig superfamily of proteins. The HUGO Gene Nomenclature Committee (HGNC) provides a list of members of the Ig-like domain containing family.

An immunoglobulin-type binding region may be a polypeptide sequence of an antibody or antigen-binding fragment thereof wherein the amino acid sequence has been varied from that of a native antibody or an Ig-like domain of a non-immunoglobulin protein, for example by molecular engineering or selection by library screening. Because of the relevance of recombinant DNA techniques and in vitro library screening in the generation of immunoglobulin-type binding regions, antibodies may be redesigned to obtain desired characteristics, such as smaller size, cell entry, or other therapeutic improvements. The possible variations are many and may range from the changing of just one amino acid to the complete redesign of; for example, a variable region. Typically, changes in the variable region will be made in order to improve the antigen-binding characteristics, improve variable region stability, or reduce the potential for immunogenic responses.

There are numerous immunoglobulin-type binding regions contemplated as components of the present invention. In certain embodiments, the immunoglobulin-type binding region is derived from an immunoglobulin binding region, such as an antibody paratope capable of binding a target biomolecule. In certain other embodiments, the immunoglobulin-type binding region comprises an engineered polypeptide not derived from any immunoglobulin domain but which functions like an immunoglobulin binding region by providing high-affinity binding to a target biomolecule. This engineered polypeptide may optionally include polypeptide scaffolds comprising or consisting essentially of complementary determining regions from immunoglobulins as described herein.

There are numerous binding regions in the prior art that are useful for targeting polypeptides to specific cell-types via their high-affinity binding characteristics. In certain embodiments, the binding region of the cytotoxic protein or polypeptide of the present invention is selected from the group which includes single-domain antibody domains (sdAb), nanobodies, heavy-chain antibody domains derived from camelids ($V_H$H fragments), bivalent nanobodies, heavy-chain antibody domains derived from cartilaginous fishes, immunoglobulin new antigen receptors (IgNARs), $V_{NAR}$ fragments, single-chain variable (scFv) fragments, multimerizing scFv fragments (diabodies, triabodies, tetrabodies), bispecific tandem scFv fragments, disulfide stabilized antibody variable (Fv) fragments, disulfide stabilized antigen-binding (Fab) fragments consisting of the $V_L$, $V_H$, $C_L$ and $C_H1$ domains, divalent F(ab')2 fragments, Fd fragments consisting of the heavy chain and $C_H1$ domains, single chain Fv-$C_H3$ minibodies, bispecific minibodies, dimeric $C_H2$ domain fragments ($C_H2D$), Fc antigen binding domains (Fcabs), isolated complementary determining region 3 (CDR3) fragments, constrained framework region 3, CDR3, framework region 4 (FR3-CDR3-FR4) polypeptides, small modular immunopharmaceutical (SMIP) domains, and any genetically manipulated counterparts of the foregoing that retain its paratope and binding function (see Saerens D et al., *Curr Opin Pharmacol* 8: 600-8 (2008); Dimitrov D, *MAbs* 1: 26-8 (2009); Weiner L, *Cell* 148: 1081-4 (2012); Ahmad Z et al., *Clin Dev Immunol* 2012: 980250 (2012)).

In accordance with certain other embodiments, the binding region includes engineered, alternative scaffolds to immunoglobulin domains that exhibit similar functional characteristics, such as high-affinity and specific binding of target biomolecules, and enables the engineering of improved characteristics, such as greater stability or reduced immunogenicity. For certain embodiments of the cytotoxic proteins or polypeptides of the invention, the binding region is selected from the group which includes engineered, fibronectin-derived, $10^{th}$ fibronectin type III (10Fn3) domain (monobodies, AdNectins™, or AdNexins™); engineered, tenascin-derived, tenascin type III domain (Centryns™); engineered, ankyrin repeat motif containing polypeptide (DARPins™); engineered, low-density-lipoprotein-receptor-derived, A domain (LDLR-A) (Avimers™); lipocalin (anticalins); engineered, protease inhibitor-derived, Kunitz domain; engineered, Protein-A-derived, Z domain (Affibodies™); engineered, gamma-B crystalline-derived scaffold or engineered, ubiquitin-derived scaffold (Affilins); Sac7d-derived polypeptides (Nanoffitins™ or affitins); engineered, Fyn-derived, SH2 domain (Fynomers®); miniproteins; C-type lectin-like domain scaffolds, engineered antibody mimic, and any genetically manipulated counterparts of the foregoing that retains its binding functionality (Wörn A, Plückthun A, *J Mol Biol* 305: 989-1010 (2001); Xu L et al., *Chem Biol* 9: 933-42 (2002); Wikman M et al., *Protein Eng Des Sel* 17: 455-62 (2004); Binz H et al., *Nat Biotechnol* 23: 1257-68 (2005); Hey T et al., *Trends Biotechnol* 23:514-522 (2005); Holliger P, Hudson P, *Nat Biotechnol* 23: 1126-36 (2005); Gill D, Damle N, *Curr Opin Biotech* 17: 653-8 (2006); Koide A, Koide S, *Methods Mol Biol* 352: 95-109 (2007); Byla P et al., *J Biol Chem* 285: 12096 (2010); Zoller F et al., *Molecules* 16: 2467-85 (2011)). Generally, alternative scaffolds to immunoglobulins are less than 20 kiloDaltons, consist of a single polypeptide chain, lack cysteine residues, and relatively high thermodynamic stability.

Any of the above binding regions may be used as a component of the present invention so long as the binding region component has a dissociation constant of $10^{-5}$ to $10^{-12}$ moles per liter, preferably less than 200 nM, towards a target biomolecule as described herein. Specific target biomolecules may be selected based on numerous criteria.

Target Biomolecules of the Cytotoxic Polypeptides of the Invention

The binding regions of the cytotoxic polypeptides of the present invention may be designed or selected based on numerous criteria, such as the cell-type specific expression of their target biomolecules and/or the physical localization of their target biomolecules with regard to specific cell types. For example, certain cytotoxic polypeptides of the present invention comprise binding regions capable of binding cell-surface targets which are expressed exclusively by only one cell-type to the cell surface.

Certain binding regions of the cytotoxic polypeptides of the present invention comprise a polypeptide region capable of binding specifically to an intracellular target biomolecule. Non-limiting examples of intracellular target biomolecules include Brutin's tyrosine kinases (BTK kinases), cyclin-dependent kinases (CDKs), GTPases such as small Ras GTPases, Myc transcription factors, phosphatase of regenerating liver 3 (PRL-3), polyomavirus middle T oncoprotein (mT), Rafkinases, spleen tyrosine kinases such as Syk-ZAP-70, and Src kinases such as c-Src and v-Src (see e.g. Guo K et al., *Sci Transl Med* 3: 99ra85 (2011)).

Certain binding regions of the cytotoxic polypeptides of the present invention comprise a polypeptide region capable of binding specifically to an extracellular target biomolecule, preferably which is physically-coupled to the surface of a cell type of interest, such as a cancer cell, tumor cell, plasma cell, infected cell, or host cell harboring an intracellular pathogen.

The term "target biomolecule" refers to a biological molecule, commonly a protein or a protein modified by post-translational modifications, such as glycosylation, which is capable of being bound by a binding region to target a protein to a specific cell-type or location within an organism. Extracellular target biomolecules may include various epitopes, including unmodified polypeptides, polypeptides modified by the addition of biochemical functional groups, and glycolipids (see e.g. U.S. Pat. No. 5,091,178; EP 2431743). It is desirable that an extracellular target biomolecule be endogenously internalized or be readily forced to internalize upon interaction with a cell-targeted molecule of the present invention.

In addition, target biomolecules need not be natively present because target cells may be induced and/or forced to express target biomolecules by artificial means, such as, e.g., after infection using viral expression vector systems, exposure to certain compounds, and/or exposure to certain types of electromagnetic radiation.

For purposes of the present invention, the term "extracellular" with regard to modifying a target biomolecule refers to a biomolecule that has at least a portion of its structure exposed to the extracellular environment. Extracellular target biomolecules include cell membrane components, transmembrane spanning proteins, cell membrane-anchored biomolecules, cell-surface-bound biomolecules, and secreted biomolecules. Extracellular target biomolecules of the binding region of the cytotoxic polypeptides of the invention may include biomarkers over-proportionately or exclusively present on cancer cells, immune cells, and cells infected with intracellular pathogens, such as viruses, bacteria, fungi, prions, or protozoans. Commonly for extracellular target biomolecules which are cell-surface localized, the binding regions are chosen such that their extracellular target biomolecules are physically coupled specifically to cells being targeted for killing but are absent or very rare on cells that are not targeted for killing.

With regard to the present invention, the phrase "physically coupled" when used to describe a target biomolecule means both covalent and/or non-covalent intermolecular interactions that couple the target biomolecule, or a portion thereof, to the outside of a cell, such as a plurality of non-covalent interactions between the target biomolecule and the cell where the energy of each single interaction is on the order of about 1-5 kiloCalories (e.g. electrostatic bonds, hydrogen bonds, Van der Walls interactions, hydrophobic forces, etc.). By definition, all integral membrane proteins are physically coupled to a cell membrane, and peripheral membrane proteins are physically coupled to cell membranes as well. For example, an extracellular target biomolecule may comprise a transmembrane spanning region, a lipid anchor, a glycolipid anchor, and/or be non-covalently associated (e.g. via non-specific hydrophobic interactions and/or lipid binding interactions) with a factor comprising any one of the foregoing.

In certain embodiments, the binding region comprises or consists essentially of an immunoglobulin-type polypeptide selected for specific and high-affinity binding to a surface antigen on the cell surface of a cancer cell, where the antigen is restricted in expression to cancer cells (see Glökler J et al., *Molecules* 15: 2478-90 (2010); Liu Y et al., *Lab Chip* 9: 1033-6 (2009). In accordance with other embodiments, the binding region is selected for specific and high-affinity binding to a surface antigen on the cell surface of a cancer cell, where the antigen is overexpressed or preferentially expressed by cancer cells as compared to non-cancer cells (see, e.g., Dantas-Barbosa C et al., *Int J Mol Sci* 12: 5420-40 (2012). Some representative target biomolecules include, but are not limited the following enumerated targets associated with cancers and/or specific immune cell types.

Many immunoglobulin-type binding regions that recognize epitopes associated with cancer cells exist in the prior art, such as binding regions that target (alternative names are indicated in parentheses) annexin AI, B3 melanoma antigen, B4 melanoma antigen, CD2, CD3, CD4, CD20 (B-lymphocyte antigen protein CD20), CD22, CD25 (interleukin-2 receptor IL2R), CD30 (TNFRSF8), CD38 (cyclic ADP ribose hydrolase), CD40, CD44 (hyaluronan receptor), ITGAV (CD51), CD66, CD71 (transferrin receptor), CD73, CD74 (HLA-DR antigens-associated invariant chain), CD79, CD98, endoglin (END or CD105), CD106 (VCAM-1), chemokine receptor type 4 (CDCR-4, fusin, CD184), CD200, insulin-like growth factor 1 receptor (CD221), mucin1 (MUC1, CD227), basal cell adhesion molecule (B-CAM or CD239), CD248 (endosialin or TEM1), tumor necrosis factor receptor 10b (TNFRSF10B, CD262), tumor necrosis factor receptor 13B (TNFRSF13B, TACI, CD276), vascular endothelial growth factor receptor 2 (KDR, CD309), epithelial cell adhesion molecule (EpCAM, CD326), human epidermal growth factor receptor 2 (HER2/Neu/ErbB2/CD340), cancer antigen 15-3 (CA15-3), cancer antigen 19-9 (CA 19-9), cancer antigen 125 (CA125, MUC16), CA242, carcinoembryonic antigen-related cell adhesion molecules (e.g. CEACAM3 (CD66d) and CEACAM5), carcinoembryonic antigen protein (CEA), chondroitin sulfate proteoglycan 4 (CSP4, MCSP, NG2), CTLA4, DLL4, epidermal growth factor receptor (EGFR/

ErbB1), folate receptor (FOLR), G-28, ganglioside GD2, ganglioside GD3, HLA-Dr10, HLA-DRB, human epidermal growth factor receptor 1 (HER1), Ephrin type-B receptor 2 (EphB2), epithelial cell adhesion molecule (EpCAM), fibroblast activation protein (FAP/seprase), insulin-like growth factor 1 receptor (IGF1R), interleukin 2 receptor (IL-2R), interleukin 6 receptor (IL-6R), integrins alpha-V beta-3 ($\alpha v\beta_3$), integrins alpha-V beta-5 ($\alpha v\beta 5$), integrins alpha-5 beta-1 ($\alpha_5\beta_1$), L6, MPG, melanoma-associated antigen 1 protein (MAGE-1), melanoma-associated antigen 3 (MAGE-3), mesothelin (MSLN), MPG, MS4A, p21, p97, polio virus receptor-like 4 (PVRL4), protease-activated-receptors (such as PAR1), prostate-specific membrane antigen protein (PSMA), trophoblast glycoprotein (TPGB), and tumor-associated calcium signal transducers (TACSTDs) (see e.g. Lui B et al., *Cancer Res* 64: 704-10 (2004); Novellino L et al., *Cancer Immunol Immunother* 54: 187-207 (2005); Bagley R et al., *Int J Oncol* 34: 619-27 (2009); Gerber H et al., *mAbs* 1: 247-53 (2009); Beck A et al., *Nat Rev Immunol* 10: 345-52 (2010); Andersen J et al., *J Biol Chem* 287: 22927-37 (2012); Nolan-Stevaux O et al., *PLoS One* 7: e50920 (2012); Rust S et al., *Mol Cancer* 12: 11 (2013)). This list of target biomolecules is intended to be non-limiting. It will be appreciated by the skilled worker that any desired target biomolecule associated with a cancer cell type may be used to design or select a binding region to be coupled with a ribotoxic region to produce a cytotoxic protein or polypeptide of the invention.

Examples of other target biomolecules which are strongly associated with cancer cells are BAGE proteins (B melanoma antigens), basal cell adhesion molecules (BCAMs or Lutheran blood group glycoproteins), bladder tumor antigen (BTA), cancer-testis antigen NY-ESO-1, cancer-testis antigen LAGE proteins, CD19 (B-lymphocyte antigen protein CD19), CD21 (complement receptor-2 or complement 3d receptor), CD26 (dipeptidyl peptidase-4, DPP4, or adenosine deaminase complexing protein 2), CD33 (sialic acid-binding immunoglobulin-type lectin-3), CD52 (CAMPATH-1 antigen), CD56, CS1 (SLAM family number 7 or SLAMF7), cell surface A33 antigen protein (gpA33), Epstein-Barr virus antigen proteins, GAGE/PAGE proteins (melanoma associated cancer/testis antigens), hepatocyte growth factor receptor (HGFR or c-Met), MAGE proteins, melanoma antigen recognized by T-cells 1 protein (MART-1/MelanA, MARTI), mucins, Preferentially Expressed Antigen of Melanoma (PRAME) proteins, prostate specific antigen protein (PSA), prostate stem cell antigen protein (PSCA), Receptor for Advanced Glycation Endroducts (RAGE), tumor-associated glycoprotein 72 (TAG-72), vascular endothelial growth factor receptors (VEGFRs), and Wilms' tumor antigen. This list of target biomolecules is intended to be non-limiting.

Examples of other target biomolecules which are strongly associated with cancer cells are carbonic anhydrase IX (CA9/CAIX), claudin proteins (CLDN3, CLDN4), ephrin type-A receptor 3 (EphA3), folate binding proteins (FBP), ganglioside GM2, insulin-like growth factor receptors, integrins (such as CD11a-c), receptor activator of nuclear factor kappa B (RANK), receptor tyrosine-protein kinase erB-3, tumor necrosis factor receptor 10A (TRAIL-R1/DR4), tumor necrosis factor receptor 10B (TRAIL-R2), tenascin C, and CD64 (FcγRI) (see Hough C et al., *Cancer Res* 60: 6281-7 (2000); Thepen T et al., *Nat Biotechnol* 18: 48-51 (2000); Pastan I et al., *Nat Rev Cancer* 6: 559-65 (2006); Pastan, *Annu Rev Med* 58: 221-37 (2007); Fitzgerald D et al., *Cancer Res* 71: 6300-9 (2011); Scott et al., *Cancer Immun* 12: 14-22 (2012)). This list of target biomolecules is intended to be non-limiting.

In addition, there are numerous other examples of contemplated, target biomolecules such as ADAM metalloproteinases (e.g. ADAM-9, ADAM-10, ADAM-12, ADAM-15, ADAM-17), ADP-ribosyltransferases (ART1, ART4), antigen F4/80, bone marrow stroma antigens (BST1, BST2), break point cluster region-c-abl oncogene (BCR-ABL) proteins, C3aR (complement component 3a receptors), CD7, CD13, CD14, CD15 (Lewis X or stage-specific embryonic antigen 1), CD23 (FC epsilon RII), CD49d, CD53, CD54 (intercellular adhesion molecule 1), CD63 (tetraspanin), CD69, CD80, CD86, CD88 (complement component 5a receptor 1), CD115 (colony stimulating factor 1 receptor), CD123 (interleukin-3 receptor), CD129 (interleukin 9 receptor), CD183 (chemokine receptor CXCR3), CD191 (CCR1), CD193 (CCR3), CD195 (chemokine receptor CCR5), CD203c, CD225 (interferon-induced transmembrane protein 1), CD244 (Natural Killer Cell Receptor 2B4), CD282 (toll-like receptor 2), CD284 (Toll-like receptor 4), CD294 (GPR44), CD305 (leukocyte-associated immunoglobulin-like receptor 1), ephrin type-A receptor 2 (EphA2), FceRIa, galectin-9, alpha-fetoprotein antigen 17-A1 protein, human aspartyl (asparaginyl) beta-hydroxylase (HAAH), immunoglobulin-like transcript ILT-3, lysophosphatidlglycerol acyltransferase 1 (LPGAT1/IAA0205), lysosome-associated membrane proteins (LAMPs, such as CD107), melanocyte protein PMEL (gp100), myeloid-related protein-14 (mrp-14), receptor tyrosine-protein kinase erbB-3, SART proteins, scavenger receptors (such as CD64 and CD68), Siglecs (sialic acid-binding immunoglobulin-type lectins), syndecans (such as SDC1 or CD138), tyrosinase, tyrosinase-related protein 1 (TRP-1), tyrosinase-related protein 2 (TRP-2), tyrosinase associated antigen (TAA), APO-3, BCMA, CD2, CD3, CD4, CD8, CD18, CD27, CD28, CD29, CD41, CD49, CD90, CD95 (Fas), CD103, CD104, CD134 (OX40), CD137 (4-1BB), CD152 (CTLA-4), chemokine receptors, complement proteins, cytokine receptors, histocompatibility proteins, ICOS, interferon-alpha, interferon-beta, c-myc, osteoprotegerin, PD-1, p53, RANK, TACI, TNF receptor superfamily member (TNF-R1, TNFR-2), Apo2/TRAIL-R1, TRAIL-R2, TRAIL-R3, and TRAIL-R4 (see, Scott A et al., *Cancer Immunity* 12: 14 (2012); Cheever M et al., *Clin Cancer Res* 15: 5323-37 (2009), for target biomolecules and note the target molecules described therein are non-limiting examples).

In certain embodiments, the binding region comprises or consists essentially of an immunoglobulin-type polypeptide selected for specific and high-affinity binding to the cellular surface of a cell type of the immune system. For example, immunoglobulin-type binding domains are known that bind to CD1, CD2, CD3, CD4, CD5, CD6, CD7, CD8, CD9, CD10, CD11, CD12, CD13, CD14, CD15, CD16, CD17, CD18, CD19, CD20, CD21, CD22, CD23, CD24, CD25, CD26, CD27, CD28, CD29, CD30, CD31, CD33, CD34, CD35, CD36, CD37, CD38, CD40, CD41, CD56, CD61, CD62, CD66, CD95, CD117, CD123, CD235, CD146, CD326, interleukin-2 receptor (IL-2R), receptor activator of nuclear factor kappa B (RANKL), SLAM-associated protein (SAP), and TNFSF18 (tumor necrosis factor ligand 18 or GITRL).

In certain embodiments, the binding region comprises or consists essentially of ligand selected for targeting an extracellular receptor. Some representative ligands include, but are not limited to, the following bone morphogenetic proteins and activin membrane-bound inhibitor BAMBI (also known as TGFBR), CD137L (also known as 4-1BB), decoy receptor 3 DcR3 (also known as TR6 and TNFRSF6B), and the tumor necrosis factor TWEAK (also known as TNFSF12 and APO3L).

It will be appreciated by the skilled worker that any desired target biomolecule may be used to select for novel binding regions using a method of the present invention in order to create a cytotoxic polypeptide of the invention.

C. Linkages Connecting the Ribotoxic Region and Binding Region Polypeptide Components of the Cytotoxic Proteins and Fusion Polypeptides of the Invention The ribotoxic region and binding region polypeptides of the cytotoxic proteins and cytotoxic polypeptides of the present invention may be suitably linked to each other directly or indirectly via one or more linkers well known in the art and/or described herein. The ribotoxic region and binding region polypeptides of the chimeric fusion polypeptides of the present invention may be suitably linked to each other directly, without any intervening amino acid residue(s), or indirectly via one or more proteinaceous linkers, comprising one or more amino acid residues, well known in the art and/or described herein.

Suitable linkers include single amino acids, peptides, and polypeptides (see e.g. Chen X et al., *Adv Drug Deliv Rev* 65: 1357-69 (2013)). Individual polypeptide subcomponents of the binding regions, e.g. heavy chain variable regions (V$_H$), light chain variable regions (V$_L$), CDR, and/or ABR regions, may be suitably linked to each other via one or more linkers well known in the art and/or described herein (see e.g. Weisser N, Hall J, *Biotechnol Adv* 27: 502-20 (2009); Chen X et al., *Adv Drug Deliv Rev* 65: 1357-69 (2013)). Peptide components of the chimeric fusion polypeptides of the invention, e.g., KDEL ("KDEL" disclosed as SEQ ID NO:65) family endoplasmic reticulum retention/retrieval signal motifs, may be suitably linked to another polypeptide component of the invention via one or more linkers, such as a proteinaceous linker, which are well known in the art.

Suitable linkers are generally those which allow each polypeptide component of the present invention to fold with a three-dimensional structure very similar to the polypeptide components produced individually without any linker or other component. Suitable linkers include single amino acids, peptides, polypeptides, and linkers lacking any of the aforementioned such as various non-proteinaceous carbon chains, whether branched or cyclic (see e.g. Chen X et al., *Adv Drug Deliv Rev* 65: 1357-69 (2013)).

Suitable linkers may be proteinaceous and comprise one or more amino acids, peptides, and/or polypeptides. Proteinaceous linkers are suitable for both recombinant fusion proteins and chemically linked conjugates. A proteinaceous linker typically has from about 2 to about 50 amino acid residues, such as, e.g., from about 5 to about 30 or from about 6 to about 25 amino acid residues. The length of the linker selected will depend upon a variety of factors, such as, e.g., the desired property or properties for which the linker is being selected (see e.g. Chen X et al., *Adv Drug Deliv Rev* 65: 1357-69 (2013)).

Suitable linkers may be non-proteinaceous, such as, e.g. chemical linkers (see e.g. Dosio F et al., *Toxins* 3: 848-83 (2011); Feld J et al., *Oncotarget* 4: 397-412 (2013)). Various non-proteinaceous linkers known in the art may be used to link components of the cytotoxic proteins of the present invention, such as linkers commonly used to conjugate immunoglobulin-derived polypeptides to heterologous polypeptides. For example, polypeptide regions may be linked using the functional side chains of their amino acid residues and carbohydrate moieties such as, e.g., a carboxy, amine, sulfhydryl, carboxylic acid, carbonyl, hydroxyl, and/or cyclic ring group. For example, disulfide bonds and thioether bonds may be used to link two or more polypeptides (see e.g. Fitzgerald D et al., *Bioconjugate Chem* 1: 264-8 (1990); Pasqualucci L et al., *Haematologica* 80: 546-56 (1995)). In addition, non-natural amino acid residues may be used with other functional side chains, such as ketone groups (see e.g. Sun S et al., *Chembiochem* July 18 (2014); Tian F et al., *Proc Natl Acad Sci USA* 111: 1766-71 (2014)). Examples of non-proteinaceous chemical linkers include but are not limited to N-succinimidyl (4-iodoacetyl)-aminobenzoate, S—(N-succinimidyl) thioacetate (SATA), N-succinimidyl-oxycarbonyl-cu-methyl-a-(2-pyridyldithio) toluene (SMPT), N-succinimidyl 4-(2-pyridyldithio)-pentanoate (SPP), succinimidyl 4-(N-maleimidomethyl) cyclohexane carboxylate (SMCC or MCC), sulfosuccinimidyl (4-iodoacetyl)-aminobenzoate, 4-succinimidyl-oxycarbonyl-α-(2-pyridyldithio) toluene, sulfosuccinimidyl-6-(α-methyl-α-(pyridyldithiol)-toluamido) hexanoate, N-succinimidyl-3-(-2-pyridyldithio)-proprionate (SPDP), succinimidyl 6(3(-(-2-pyridyldithio)-proprionamido) hexanoate, sulfosuccinimidyl 6(3(-(-2-pyridyldithio)-propionamido) hexanoate, maleimidocaproyl (MC), maleimidocaproyl-valine-citrulline-p-aminobenzyloxycarbonyl (MC-vc-PAB), 3-maleimidobenzoic acid N-hydroxysuccinimide ester (MBS), alpha-alkyl derivatives, sulfoNHS-ATMBA (sulfosuccinimidyl N-[3-(acetylthio)-3-methylbutyryl-beta-alanine]), sulfodicholorphenol, 2-iminothiolane, 3-(2-pyridyldithio)-propionyl hydrazide, Eliman's reagent, dichlorotriazinic acid, and S-(2-thiopyridyl)-L-cysteine (see e.g. Thorpe P et al., *Eur J Biochem* 147: 197-206 (1985); Thorpe P et al., *Cancer Res* 47: 5924-31 (1987); Thorpe P et al., *Cancer Res* 48: 6396-403 (1988); Grossbard M et al., *Blood* 79: 576-85 (1992); Lui C et al., *Proc Natl Acad Sci USA* 93: 8618-23 (1996); Doronina S et al., *Nat Biotechnol* 21: 778-84 (2003); Feld J et al., *Oncotarget* 4: 397-412 (2013)).

Suitable linkers, whether proteinaceous or non-proteinaceous, may include, e.g., protease sensitive, environmental redox potential sensitive, pH sensitive, acid cleavable, photocleavable, and/or heat sensitive linkers (see e.g. Dosio F et al., *Toxins* 3: 848-83 (2011); Chen X et al., *Adv Drug Deliv Rev* 65: 1357-69 (2013); Feld J et al., *Oncotarget* 4: 397-412 (2013)).

Proteinaceous linkers may be chosen for incorporation into recombinant fusion polypeptides of the present invention. For cytotoxic fusion polypeptides of the invention, linkers typically comprise about 2 to 50 amino acid residues, preferably about 5 to 30 amino acid residues (Argos P, *J Mol Biol* 211: 943-58 (1990); Williamson M, *Biochem J* 297: 240-60 (1994); George R, Heringa J, *Protein Eng* 15: 871-9 (2002); Kreitman R, *AAPS J* 8: E532-51 (2006)). Commonly, proteinaceous linkers comprise a majority of amino acid residues with polar, uncharged, and/or charged residues, such as, e.g., threonine, proline, glutamine, glycine, and alanine (see e.g. Huston J et al. *Proc Natl Acad Sci U.S.A.* 85: 5879-83 (1988); Pastan I et al., *Annu Rev Med* 58:221-37 (2007); Li J et al., *Cell Immunol* 118: 85-99 (1989); Cumber A et al. *Bioconj Chem* 3: 397-401 (1992); Friedman P et al., *Cancer Res* 53: 334-9 (1993); Whitlow M et al., *Protein Engineering* 6: 989-95 (1993); Siegall C et al., *J Immunol* 152: 2377-84 (1994); Newton et al. *Biochemistry* 35: 545-53 (1996); Ladurner et al., *J Mol Biol* 273: 330-7 (1997); Kreitman R et al., *Leuk Lymphoma* 52: 82-6 (2011); U.S. Pat. No. 4,894,443). Non-limiting examples of proteinaceous linkers include alanine-serine-glycine-glycine-proline-glutamate (ASGGPE (SEQ ID NO:66)), valine-methionine (VM), alanine-methionine (AM), AM(G$_2$ $_{to}$ $_4$S)$_x$AM where G is glycine, S is serine, and x is an integer from 1 to 10 (SEQ ID NO:67).

Proteinaceous linkers may be selected based upon the properties desired. Proteinaceous linkers may be chosen by the skilled worker with specific features in mind, such as to optimize one or more of the fusion molecule's folding, stability, expression, solubility, pharmacokinetic properties, pharmacodynamic properties, and/or the activity of the fused domains in the context of a fusion construct as compared to the activity of the same domain by itself. For example, proteinaceous linkers may be selected based on flexibility, rigidity, and/or cleavability (see e.g. Chen X et al., *Adv Drug Deliv Rev* 65: 1357-69 (2013)). The skilled worker may use databases and linker design software tools when choosing linkers. In certain linkers may be chosen to optimize expression (see e.g. Turner D et al., *J Immunol Methods* 205: 43-54 (1997)). In certain linkers may be chosen to promote intermolecular interactions between identical polypeptides or proteins to form homomultimers or different polypeptides or proteins to form heteromultimers. For example, proteinaceous linkers may be selected which allow for desired non-covalent interactions between polypeptide components of the cytotoxic proteins and cytotoxic polypeptides of the invention, such as, e.g., interactions related to the formation dimers and other higher order multimers (see e.g. U.S. Pat. No. 4,946,778).

Flexible proteinaceous linkers are often greater than 12 amino acid residues long and rich in small, non-polar amino acid residues, polar amino acid residues, and/or hydrophilic amino acid residues, such as, e.g., glycines, serines, and threonines (see e.g. Bird R et al., *Science* 242: 423-6 (1988); Friedman P et al., *Cancer Res* 53: 334-9 (1993); Siegall C et al., *J Immunol* 152: 2377-84 (1994)). Flexible proteinaceous linkers may be chosen to increase the spatial separation between components and/or to allow for intramolecular interactions between components. For example, various "GS" linkers are known to the skilled worker and are composed of multiple glycines and/or one or more serines, sometimes in repeating units, such as, e.g., (G$_x$S)$_n$ (SEQ ID NO:68), (S$_x$G)$_n$ (SEQ ID NO:69), (GGGGS)$_n$ (SEQ ID NO:70), and (G)$_n$ (SEQ ID NO:71). in which x is 1 to 6 and n is 1 to 30 (see e.g. WO 96/06641). Non-limiting examples of flexible proteinaceous linkers include GKSSGSGSESKS (SEQ ID NO:72), GSTSGSGKSSEGKG (SEQ ID NO:73), GSTSGSGKSSEGSGSTKG (SEQ ID NO:74), GSTSGS-GKPGSGEGSTKG (SEQ ID NO:75), EGKSSGSGSESKEF (SEQ ID NO:76), SRSSG (SEQ ID NO:77), and SGSSC (SEQ ID NO:78).

Rigid proteinaceous linkers are often stiff alpha-helical structures and rich in proline residues and/or one or more strategically placed prolines (see Chen X et al., *Adv Drug Deliv Rev* 65: 1357-69 (2013)). Rigid linkers may be chosen to prevent intramolecular interactions between linked components.

Suitable linkers may be chosen to allow for in vivo separation of components, such as, e.g., due to cleavage and/or environment-specific instability (see Dosio F et al., *Toxins* 3: 848-83 (2011); Chen X et al., *Adv Drug Deliv Rev* 65: 1357-69 (2013)). In vivo cleavable proteinaceous linkers are capable of unlinking by proteolytic processing and/or reducing environments often at a specific site within an organism or inside a certain cell type (see e.g. Doronina S et al., *Bioconjug Chem* 17: 144-24 (2006); Erickson H et al., *Cancer Res* 66: 4426-33 (2006)). In vivo cleavable proteinaceous linkers often comprise protease sensitive motifs and/or disulfide bonds formed by one or more cysteine pairs (see e.g. Pietersz G et al., *Cancer Res* 48: 4469-76 (1998); The J et al., *J Immunol Methods* 110: 101-9 (1998); see Chen X et al., *Adv Drug Deliv Rev* 65: 1357-69 (2013)). In vivo cleavable proteinaceous linkers may be designed to be sensitive to proteases that exist only at certain locations in an organism, compartments within a cell, and/or become active only under certain physiological or pathological conditions (such as, e.g., proteases with abnormally high levels, proteases overexpressed at certain disease sites, and proteases specifically expressed by a pathogenic microorganism). For example, there are proteinaceous linkers known in the art which are cleaved by proteases present only intracellularly, proteases present only within specific cell types, and proteases present only under pathological conditions like cancer or inflammation, such as, e.g., R-x-x-R motif and AMGRSGGGCAGNRVGSSLSCGGLNLQAM (SEQ ID NO:79).

In certain embodiments of the cytotoxic proteins and polypeptides of the present invention, a linker may be used which comprises one or more protease sensitive sites to provide for cleavage by a protease present within a target cell. In certain embodiments of the cytotoxic proteins and polypeptides of the invention, a linker may be used which is not cleavable to reduce unwanted toxicity after administration to a vertebrate organism.

Suitable linkers may include, e.g., protease sensitive, environmental redox potential sensitive, pH sensitive, acid cleavable, photocleavable, and/or heat sensitive linkers, whether proteinaceous or non-proteinaceous (see Chen X et al., *Adv Drug Deliv Rev* 65: 1357-69 (2013)).

Suitable cleavable linkers may include linkers comprising cleavable groups which are known in the art such as, e.g., Zarling D et al., *J Immunol* 124: 913-20 (1980); Jung S, Moroi M, *Biochem Biophys Acta* 761: 152-62 (1983); Bouizar Z et al., *Eur J Biochem* 155: 141-7 (1986); Park L et al., *J Biol Chem* 261: 205-10 (1986); Browning J, Ribolini A, *J Immunol* 143: 1859-67 (1989); Joshi S, Burrows R, *J Biol Chem* 265: 14518-25 (1990)).

Suitable linkers may include pH sensitive linkers. For example, certain suitable linkers may be chosen for their instability in lower pH environments to provide for dissociation inside a subcellular compartment of a target cell. For example, linkers that comprise one or more trityl groups, derivatized trityl groups, bismaleimideothoxy propane groups, adipic acid dihydrazide groups, and/or acid labile transferrin groups, may provide for release of components of the cytotoxic proteins and polypeptides of the invention, e.g. a polypeptide component, in environments with specific pH ranges (see e.g. Welhöner H et al., *J Biol Chem* 266: 4309-14 (1991); Fattom A et al., *Infect Immun* 60: 584-9 (1992)). In certain linkers may be chosen which are cleaved in pH ranges corresponding to physiological pH differences between tissues, such as, e.g., the pH of tumor tissue is lower than in healthy tissues (see e.g. U.S. Pat. No. 5,612,474).

Photocleavable linkers are linkers that are cleaved upon exposure to electromagnetic radiation of certain wavelength ranges, such as light in the visible range (see e.g. Goldmacher V et al., *Bioconj Chem* 3: 104-7 (1992)). Photocleavable linkers may be used to release a component of a cytotoxic protein or polypeptide of the invention, e.g. a polypeptide component, upon exposure to light of certain wavelengths. Non-limiting examples of photocleavable linkers include a nitrobenzyl group as a photocleavable protective group for cysteine, nitrobenzyloxycarbonyl chloride cross-linkers, hydroxypropylmethacrylamide copolymer, glycine copolymer, fluorescein copolymer, and methylrhodamine copolymer (Hazum E et al., *Pept Proc Eur Pept*

Symp. 16th, Brunfeldt K, ed., 105-110 (1981); Senter et al., *Photochem Photobiol* 42: 231-7 (1985); Yen et al., *Makromol Chem* 190: 69-82 (1989); Goldmacher V et al., *Bioconj Chem* 3: 104-7 (1992)). Photocleavable linkers may have particular uses in linking components to form cytotoxic proteins and polypeptides of the invention designed for treating diseases, disorders, and conditions that can be exposed to light using fiber optics.

In certain embodiments of the cytotoxic proteins of the present invention, a cell-targeting binding region is linked to a ribotoxic polypeptide using any number of means known to the skilled worker, including both covalent and noncovalent linkages (see e.g. Chen X et al., *Adv Drug Deliv Rev* 65: 1357-69 (2013); Behrens C, Liu B, *MAbs* 6: 46-53 (2014).

In certain embodiments of the cytotoxic proteins and polypeptides of the present invention, the protein comprises a binding region which is a scFv with a linker connecting a heavy chain variable ($V_H$) domain and a light chain variable ($V_L$) domain. There are numerous linkers known in the art suitable for this purpose, such as, e.g., the 15-residue (Gly4Ser)$_3$ peptide (SEQ ID NO:80). Suitable scFv linkers which may be used in forming non-covalent multivalent structures include GGS, GGGS (SEQ ID NO:81), GGGGS (SEQ ID NO:82), GGGGSGGG (SEQ ID NO:83), GGSGGGG (SEQ ID NO:84), GST-SGGGSGGGSGGGGSS (SEQ ID NO:85), and GSTSGS-GKPGSSEGSTKG (SEQ ID NO:86) (Plückthun A, Pack P, *Immunotechnology* 3: 83-105 (1997); Atwell J et al., *Protein Eng* 12: 597-604 (1999); Wu A et al., *Protein Eng* 14: 1025-33 (2001); Yazaki P et al., *J Immunol Methods* 253: 195-208 (2001); Carmichael J et al., *J Mol Biol* 326: 341-51 (2003); Arndt M et al., *FEBS Lett* 578: 257-61 (2004); Bie C et al., *World J Hepatol* 2: 185-91 (2010)).

Suitable methods for linkage of components of the cytotoxic proteins and chimeric fusion polypeptides of the present invention may be by any method presently known in the art for accomplishing such. For the purposes of the present invention, the specific order or orientation is not fixed for the ribotoxic region and the binding region in relation to each other or the entire chimeric fusion polypeptides. In certain embodiments, the binding region and ribotoxic region may be directly fused to each other and/or suitably linked to each other via one or more intervening polypeptide sequences, such as with one or more linkers well known in the art.

II. Expression Libraries for Screening Fusion Polypeptides

With regard to the present invention, the phrase "expression library" refers to a collection or pool of nucleic acids representing two or more different clones—where each clone differs in the amino acid sequence of the polypeptide for which it encodes and where each nucleic acid is capable of encoding a polypeptide comprising a binding region and a ribotoxic region whether modified or unmodified. Commonly, expression libraries are made up of expression vectors, a sequence of polynucleotides that has been constructed such that the sequences function to provide polypeptide expression. Thus, an expression library is capable of encoding two or more different polypeptides, wherein each polypeptide comprises a binding region targeting moiety and a ribotoxic region covalently linked to each other. The expression library is the collection of polynucleotides that are expressed during screening in order to select, enrich, and/or identify ribotoxic polypeptides with desirable characteristics. It is understood by the skilled worker that not every clone within a library will produce an operable fusion polypeptide, but in a well-designed library, the majority of clones will be capable of encoding a unique fusion polypeptide comprising a binding region and ribotoxic region.

An expression library may be screened by expressing the fusion polypeptides and selecting for one or more characteristics. For example, certain expression libraries of the invention are operable for the selecting of a specific characteristic using the following non-limiting examples of protein display methods: bacteriophage display, microorganism display, mammalian cell display, virus display, RNA display, ribosome display, bead surface display, and protein-DNA linkage display. With regard to protein display methods, the term display means that the produced polypeptides of the expression library are physically accessible such as, e.g., to bind or be bound by other molecules in solution, immobilized on a stationary platform such as a plastic well, plastic plate, chromatographic matrix, or affixed to a cell, virus, bacteriophage, or other relatively large molecular moiety like a microbead. The expression libraries of the invention constructed for protein display methods will have all the elements known to the skilled worker to be required for their respective protein display method(s). In general, a protein display expression library is constructed such that fusion polypeptides of the library are displayed while maintaining a physical connection to the nucleic acid which encoded it (i.e. its genotype).

The diversity of an expression library of the invention may vary due to both complexity and number of library members, but generally, greater diversities is preferred. With regard to an expression library of the invention, its diversity is a function of the complexity of the coding sequences of the nucleic acids of the library, such as, e.g., the complexity in their binding and/or toxin regions. Complexity of these nucleic acids may be achieved by mutagenesis, such as, e.g., error-prone polymerase chain reaction (PCR), site-directed mutagenesis, and/or combinatorial assembly of the nucleic acids using sequence-randomized synthetic nucleic acids and/or nucleic acid fragment recombination/shuffling techniques.

The source of polynucleotides for designing the libraries of the present invention may be from the immunoglobulin-encoding sequences of a chordate, whether naïve or biased or from a completely synthetic source. In addition, the source polynucleotides for designing the libraries of the present invention may be semi-synthetic. Knowledge of antibodyomes could be used for generation of semisynthetic libraries (see e.g. Dimitrov D, *MAbs* 2: 347-56 (2010)). Regardless of the diversity present in the source polynucleotides, diversity may be increased using techniques known in the art and/or described herein.

III. Reducing or Eliminating the Ribotoxicity of the Ribotoxic Region Polypeptide while Screening Although the goal of the screening methods of the invention is to identify chimeric cytotoxic proteins and polypeptides, the screening methods of the invention are all performed in a reduced or non-ribotoxic scenario. The elimination or reduction of ribotoxicity may be accomplished by: 1) altering the amino acid sequence of the ribotoxic region and/or 2) screening in the presence of a molecular inhibitor of the ribotoxic region. The first way may be preferred for screening ribotoxic regions derived from ribotoxins where key catalytic residues have already been described but specific molecular inhibitors have yet to be described. Conversely, the second way may be preferred for screening ribotoxic regions derived from ribotoxins where effective molecular inhibitors have already been described but key catalytic residues and/or inactivating mutations have yet to be identified. Thirdly, both ways may be combined in attempt to achieve an even greater reduction in ribotoxicity.

A. Modified Ribotoxic Regions

As referred to herein, a "modified ribotoxic region" comprises one or more mutations, i.e. amino acid substitutions, deletions, insertions, additions, or any combination thereof, which reduce or eliminate its ribotoxicity as compared to the appropriate unmodified ribotoxic region. A modified ribotoxic region may no longer be cytotoxic alone or as a component of a molecule or fusion polypeptide; however, at least one cognate unmodified ribotoxic region should exist which exhibits greater ribotoxicity. Ribotoxicities, including increases or decreases thereof may be assayed by numerous methods known to the skilled worker and/or described herein.

Commonly, ribotoxic polypeptides are derived from naturally occurring toxins and/or enzymes (e.g. RNases). As used herein, the name of a toxin might refer to multiple proteins with related structures and polypeptide sequences, such as, e.g., from different species or from the same species due to the existence of different toxin isoforms and variants related to genetic variation, polymorphisms, and/or mutations. A skilled worker will be able to identify, using techniques known in the art, which protein structures and polypeptide sequences are referred to by a given toxin name, even if it differs from a referenced sequence with the same name. For example, the term "ricin" refers to the prototypical ricin (UniProt P02879 RICI_RICCO) but there are numerous different ricins, such as, e.g., polymorphisms, homologs, paralogs, and orthologs. There are at least seven ricin wild-type ricins in *Ricinus communis* (Leshin J et al., *Toxicon* 55: 658-61 (2010)) as well as mutants and variants dues to molecular engineering (see e.g. Munishkin A, Wool I, *J Biol Chem* 270: 30581-7 (1995); Lui X et al., *MAbs* 4: 57-68 (2012)).

In certain embodiments of the present invention, the modified ribotoxic region has been altered such that it no longer supports catalytic inactivation of a ribosome in vitro. However, other means of modifying a ribotoxic region to reduce or eliminate ribotoxicity are also envisioned within the scope of the present invention. For example, certain mutations can render a ribotoxic region unable to bind its ribosome substrate despite maintaining catalytic ability observable by an in vitro assay whereas other mutations can render a ribotoxic region unable to target a specific ribonucleic acid sequence within the ribosome despite maintaining catalytic ability towards naked nucleic acids in vitro (see e.g. Alford S at al., *BMC Biochem* 10: 9 (2009); Alvarez-Garcia E et al., *Biochim Biophys Act* 1814: 1377-82 (2011); Wong Y et al., *PLoS One* 7: e49608 (2012)).

In DT, there are several amino acid residues known to be important for catalytic activity, such as, e.g., histidine-21, tyrosine-27, glycine-52, tryptophan-50, tyrosine-54, tyrosine-65, glutamate-148, and tryptophan-153 (Tweten R et al., *J Biol Chem* 260: 10392-4 (1985); Wilson B et al., *J Biol Chem* 269: 23296-301 (1994); Bell C, Eisenberg D, *Biochemistry* 36: 481-8 (1997); Cummings M et al., *Proteins* 31: 282-98 (1998); Keyvani K et al., *Life Sci* 64: 1719-24 (1999); Dolan K et al., *Biochemistry* 39: 8266-75 (2000); Zdanovskaia M et al., *Res Micrbiol* 151: 557-62 (2000); Kahn K, Bruice T, *J Am Chem Soc* 123:11960-9 (2001); Malito E et al., *Proc Natl Acad Sci USA* 109: 5229-34 (2012)). Glutamate-581 in cholix toxin is conserved with glutamate-148 in DT (Jørgenson R et al., *EMBO Rep* 9: 802-9 (2008)), and thus, mutations of glutamate-581 in cholix toxin are predicted to reduce the enzymatic activity of cholix toxin.

In PE, there are several amino acid residues known to be important for catalytic activity, such as, e.g., tryptophan-417, histidine-426, histidine-440, glycine-441, arginine-485, tryptophan-458, tryptophan-466, tyrosine-470, tyrosine-481, glutamate-546, arginine-551, glutamate-553, and tryptophan-558 (Douglas C, Collier R, *J Bacteriol* 169: 4967-71 (1987); Wilson B, Colliver R, *Curr Top Microbiol Immunol* 175: 27-41 (1992)); Beattie B et al., *Biochemistry* 35: 15134-42 (1996); Roberts T, Merrill A, *Biochem J* 367: 601-8 (2002); Yates S et al., *Biochem J* 385: 667-75 (2005); Jørgenson R et al., *EMBO Rep* 9: 802-9 (2008)). Glutamate-574 and glutamate-581 in cholix toxin is conserved with glutamate-546 and glutamate-553 in PE respectively (Jørgenson R et al., *EMBO Rep* 9: 802-9 (2008)), and thus, mutations of glutamate-574 and/or glutamate-581 in cholix toxin are predicted to reduce the enzymatic activity of cholix toxin.

Because the catalytic domains of cholix toxin, DT, PE, and other related enzymes are superimposable (Jørgensen R, et al., *J Biol Chem* 283: 10671-8 (2008)), amino acid residues required for catalytic activity may be predicted in related polypeptide sequences by sequence alignment methods known to the skilled worker.

Several members of the RIP family have been well studied with regard to catalytic residues. For example, most RIP family members share five key amino acid residues for catalysis, such as e.g., two tyrosine residues near the amino terminus of the catalytic domain, a glutamate and arginine near the center of the catalytic domain, and a tryptophan near the carboxy terminus of the catalytic domain (Lebeda F, Olson M, *Int J Biol Macromol* 24: 19-26 (1999); Mlsna D et al., *Protein Sci* 2: 429-35 (1993); de Virgilio M et al., *Toxins* 2: 2699-737 (2011); Walsh M, *Virulence* 4: 774-84 (2013))). Because the catalytic domains of members of the RIP family are superimposable, amino acid residues required for catalytic activity may be predicted in unstudied and/or new members of the RIP family by sequence alignment methods known to the skilled worker (see e.g. Husain J et al., *FEBS Lett* 342: 154-8 (1994); Ren J et al., *Structure* 2: 7-16 (1994); Lebeda F, Olson M, *Int J Biol Macromol* 24: 19-26 (1999); Ma Q et al., *Acta Crystallogr D Biol Crystallogr* 56: 185-6 (2000); Savino C et al., *FEBS Lett* 470: 239-43 (2000); Robertus J, Monzingo A, *Mini Rev Med Chem* 4: 477-86 (2004); Mishra V et al., *J Biol Chem* 280: 20712-21 (2005); Zhou C et al., *Bioinformatics* 21: 3089-96 (2005); Lubelli C et al., *Anal Biochem* 355: 102-9 (2006); Touloupakis E et al., *FEBS J* 273: 2684-92 (2006); Hou X et al., *BMC Struct Biol* 7: 29 (2007); Meyer A et al., *Biochem Biophys Res Commun* 364: 195-200 (2007); Ruggiero A et al., *Protein Pept Lett* 14: 97-100 (2007); Wang T et al., *Amino Acids* 34: 239-43 (2008)).

In the A Subunit of abrin, there are several amino acid residues important for catalytic activity, such as, e.g., tyrosine-74, tyrosine-113, glutamate-164, arginine-167, and tryptophan-198 (Hung C et al., *Eur J Biochem* 219: 83-7 (1994); Chen J et al., *Protein Eng* 10: 827-33 (1997); Xie L et al., *Eur J Biochem* 268: 5723-33 (2001)).

In charybdin, there are several amino acid residues important for catalytic activity, such as, e.g., valine-79, tyrosine-117, glutamate-167, and arginine-170 (Touloupakis E et al., *FEBS J* 273: 2684-92 (2006)).

In the A Subunit of cinnamomin, there are several amino acid residues important for catalytic activity, such as, e.g., tyrosine-75, tyrosine-115, glutamate-167, arginine-170, and tryptophan-201 (Hung C et al., *Eur J Biochem* 219: 83-7 (1994); Chen J et al., *Protein Eng* 10: 827-33 (1997)).

In luffaculin, there are several amino acid residues important for catalytic activity, such as, e.g., tyrosine-70, glutamate-85, tyrosine-110, glutamate-159, and arginine-162 (Hou X et al., *BMC Struct Biol* 7: 29 (2007)).

In luffins, there are several amino acid residues important for catalytic activity, such as, e.g., tyrosine-71, glutamate-86, tyrosine-111, glutamate-160, and arginine-163 (Ma Q et al., *Acta Crystallogr D Biol Crystallogr* 56: 185-6 (2000))

In maize RIPs, there are several amino acid residues important for catalytic activity, such as, e.g., tyrosine-79, tyrosine-115, glutamate-167, arginine-170, and tryptophan-201 (Robertus J, Monzingo A, *Mini Rev Med Chem* 4: 477-86 (2004); Yang Y et al., *J Mol Biol* 395: 897-907 (2009)).

In the PD-Ls, there are several amino acid residues important for catalytic activity, such as, e.g., tyrosine-72, tyrosine-122, glutamate-175, arginine-178, and tryptophan-207 in PDL-1 (Ruggiero A et al., *Biopolymers* 91: 1135-42 (2009)).

In the A Subunit of the mistletoe RIP, there are several amino acid residues important for catalytic activity, such as, e.g., tyrosine-66, phenylalanine-75, tyrosine-110, glutamate-159, arginine-162, glutamate-166, arginine-169, and tryptophan-193 (Langer M et al., *Biochem Biophys Res Commun* 264: 944-8 (1999); Mishra V et al., *Act Crystallogr D Biol Crystallogr* 60: 2295-2304 (2004); Mishra V et al., *J Biol Chem* 280: 20712-21 (2005); Wacker R et al., *J Pept Sci* 11: 289-302 (2005)).

In pokeweed antiviral protein (PAP), there are several amino acid residues important for catalytic activity, such as, e.g., lysine-48, tyrosine-49, arginine-67, arginine-68, asparagine-69, asparagine-70, tyrosine-72, phenylalanine-90, asparagine-91, aspartate-92, arginine-122, tyrosine-123, glutamate-176, arginine-179, tryptophan-208, and lysine-210 (Rajamohan F et al., *J Biol Chem* 275: 3382-90 (2000); Rajamohan F et al., *Biochemistry* 40: 9104-14 (2001)).

In the A chain of ricin, there are several amino acid residues known to be important for catalytic activity, such as, e.g., arginine-48, tyrosine-80, asparagine-122, tyrosine-123, glutamate-177, arginine-180, serine-203, asparagine-209, tryptophan-211, glycine-212, arginine-213, serine-215, and isoleucine-252 (Frankel A et al., *Mol Cell Biol* 9: 415-20 (1989); Schlossman D et al., *Mol Cell Biol* 9: 5012-21 (1989); Gould J et al., *Mol Gen Genet* 230: 91-90 (1991); Ready M et al., *Proteins* 10: 270-8 (1991); Rutenber E et al., *Proteins* 10: 240-50 (1991); Monzingo A, Robertus, J, *J Mol Biol* 227: 1136-45 (1992); Day P et al., *Biochemistry* 35: 11098-103 (1996); Marsden C et al., *Eur J Biochem* 27: 153-62 (2004); Pang Y et al., *PLoS One* 6: e17883 (2011)). In ricin, there are several amino acid residues which when deleted are known to impair the catalytic activity of ricin such as, e.g., N24, F25, A28, V29, Y81, V82, V83, G84, E146, E147, A148, I149, S168, F169, I170, I171, C172, I173, Q174, M175, I176, S177, E178, A179, A180, R181, F182, Q183, Y184, D202, P203, I206, T207, N210, S211, W212, and G213 (Munishkin A, Wool I, *J Biol Chem* 270: 30581-7 (1995); Berrondo M, Gray J, *Proteins* 79: 2844-60 (2011)).

In saporins, there are several amino acid residues known to be important for catalytic activity, such as, e.g., tyrosine-16, tyrosine-72, tyrosine-120, glutamate-176, arginine-179, and tryptophan-208 (Bagga S et al., *J Biol Chem* 278:4813-20 (2003); Zarovni N et al., *Canc Gene Ther* 14: 165-73 (2007); Lombardi A et al., *FASEB J* 24: 253-65 (2010)). In addition, a signal peptide may be included to reduce catalytic activity (Marshall R et al., *Plant J* 65: 218-29 (2011)).

In the A Subunits of Shiga toxins, there are several amino acid residues known to be important for catalytic activity, such as, e.g., tyrosine-77, glutamate-167, arginine-170, tyrosine-114, and tryptophan-203 have been shown to be important for the catalytic activity of Stx, Stx1, and Stx2 (Hovde C et al., *Proc Natl Acad Sci USA* 85: 2568-72 (1988); Deresiewicz R et al., *Biochemistry* 31: 3272-80 (1992); Deresiewicz R et al., *Mol Gen Genet* 241: 467-73 (1993); Ohmura M et al., *Microb Pathog* 15: 169-76 (1993); Cao C et al., *Microbiol Immunol* 38: 441-7 (1994); Suhan M, Hovde C, *Infect Immun* 66: 5252-9 (1998)). Mutating both glutamate-167 and arginine-170 eliminated the enzymatic activity of Slt-I A1 in a cell-free ribosome inactivation assay (LaPointe, *J Biol Chem* 280: 23310-18 (2005)). In another approach using de novo expression of Slt-I A1 in the endoplasmic reticulum, mutating both glutamate-167 and arginine-170 eliminated Slt-I A1 fragment cytotoxicity at that expression level (LaPointe, *J Biol Chem* 280: 23310-18 (2005)).

The most critical residues for enzymatic activity and/or cytotoxicity in the Shiga toxin A Subunits were mapped to the following residue-positions: asparagine-75, tyrosine-77, glutamate-167, arginine-170, and arginine-176 among others (Di, *Toxicon* 57: 525-39 (2011)). Mutations which specifically changes tyrosine-77 to a serine residue and glutamate-167 to an aspartate residue are known to result in a loss in catalytic activity. A double mutant construct of Stx2A which contained glutamate-167 mutated to a lysine residue and arginine-176 mutated to a lysine residue was completely inactivated. Other mutations at this position would be expected to produce toxins that lack the ability to catalytically inactivate ribosomes. Deletions, insertions, and/or inversions encompassing these amino acids or additions that disrupt the 3-D orientation of these amino acids would also be expected to alter the toxic nature of toxins in this family.

Shiga-like toxin 1 A Subunit truncations are catalytically active, capable of enzymatically inactivating ribosomes in vitro, and cytotoxic when expressed within a cell (LaPointe, *J Biol Chem* 280: 23310-18 (2005)). The smallest Shiga toxin A Subunit fragment exhibiting full enzymatic activity is a polypeptide composed of residues 1-239 of Slt1A (LaPointe, *J Biol Chem* 280: 23310-18 (2005)). Although the smallest fragment of the Shiga toxin A Subunit reported to retain substantial catalytic activity was residues 75-247 of StxA (Al-Jaufy, *Infect Immun* 62: 956-60 (1994)), a StxA truncation expressed de novo within a eukaryotic cell requires only up to residue 240 to reach the cytosol and exert catalytic inactivation of ribosomes (LaPointe, *J Biol Chem* 280: 23310-18 (2005)).

In trichosanthins, there are several amino acid residues known to be important for catalytic activity, such as, e.g., tyrosine-70, tyrosine-111, glutamate-160, arginine-163, lysine-173, arginine-174, lysine-177, and tryptophan-192 (Wong et al., *Eur J Biochem* 221: 787-91 (1994); Li et al., *Protein Eng* 12: 999-1004 (1999); Yan et al., *Toxicon* 37: 961-72 (1999); Ding et al., *Protein Eng* 16: 351-6 (2003); Guo Q et al., *Protein Eng* 16: 391-6 (2003); Chan D et al., *Nucleic Acid Res* 35: 1660-72 (2007)).

Fungal ribotoxins enzymatically target the same universally conserved SRL ribosomal structure as members of the RIP family and most fungal ribotoxins share an RNase T1 type catalytic domain sequence and secondary structure (Lacadena J et al., *FEMS Microbiol Rev* 31: 212-37 (2007)). Most fungal ribotoxins and related enzymes share three highly conserved amino acid residues for catalysis, two histidine residues and a glutamate residue (e.g. histidine-40, glutamate-58, and histidine-92 in RNase T1). A DSKKP (SEQ ID NO:87) motif is often present in fungal ribotoxins to specifically bind the SRL (Kao R, Davies J, *J Biol Chem* 274: 12576-82 (1999)). Because fungal ribotoxin catalytic domains are superimposable, amino acid residues required for catalytic activity may be predicted in unstudied and/or new fungal ribotoxins by sequence alignment methods known to the skilled worker.

For Aspf1, an internal deletion of 16 amino acid residues (positions 7-22) severely impaired its ribonucleolytic activity and cytotoxicity (Garciá-Ortega L et al., *FEBS J* 272: 2536-44 (2005)).

In mitogillin, there are several amino acid residues known to be important for catalytic activity, such as, e.g., asparagine-7, histidine-49, glutamate-95, lysine-111, arginine-120, and histidine-136 (Kao R et al., *Mol Microbiol* 29: 1019-27 (1998); Kao R, Davies J, *FEBS Lett* 466: 87-90 (2000)).

In restrictocin, there are several amino acid residues known to be important for catalytic activity, such as, e.g., tyrosine-47, histidine-49, glutamate-95, lysine-110, lysine-111, lysine-113, arginine-120, and histidine-136 (Nayak S, Batra J, *Biochemistry* 36: 13693-9 (1997); Nayak S et al., *Biochemistry* 40: 9115-24 (2001); Plantinga M et al., *Biochemistry* 50: 3004-13 (2011)).

In α-sarcin, there are several amino acid residues known to be important for catalytic activity, such as, e.g., tryptophan-48, histidine-49, histidine-50, tryptophan-51, asparagine-54, isoleucine-69, glutamate-95, glutamate-96, lysine-111, lysine-112, lysine-114, arginine-121, histidine-136, histidine-137, lysine-145 (Lacadena J et al., *Biochem J* 309: 581-6 (1995); Lacadena J et al., *Proteins* 37: 474-84 (1999); Martínez-Ruiz A et al., *Toxicon* 37: 1549-63 (1999); de Antonio C et al., *Proteins* 41: 350-61 (2000); Masip M et al., *Eur J Biochem* 268: 6190-6 (2001)).

B. Molecular Inhibitors of Ribotoxicity of Ribotoxic Regions

Another approach to creating a reduced or non-ribotoxic screening environment is to perform screening steps, such as, e.g., selection steps, in the presence of one or more molecular inhibitors of the appropriate ribotoxic region.

As used herein, the term "inhibitor" of a ribotoxic region is any chemical, such as a peptide, polypeptide, nucleic acid, or other molecule that inhibits, reduces, or eliminates the ribotoxic activity of the ribotoxic region of interest. Typically, inhibitors include any molecule that inhibits the N-glycosidase activity shared by most members of the RIP family as well as inhibitors of the RNase activities of fungal ribotoxins or the ADP-ribosylation activity of cholix toxins. Other inhibitors may include molecules that inhibit various enzymatic activities such as, e.g., ribonucleolytic activity towards nucleic acids, oligonucleosides, oligonucleotides, RNAs, or DNAs.

A non-ribotoxic screening environment may be created using a molecular inhibitor of the appropriate ribotoxic region. For example, molecules have been described which inhibit the enzymatic activity and/or ribotoxicity of various protein toxins, toxin subunits, or enzymatic domains whose polypeptide sequences may be used for or derived to form ribotoxic regions of the cytotoxic proteins and polypeptides of the present invention. In particular, the ribotoxicity and/or enzymatic activities of members of the RIP Superfamily may be inhibited by a variety of molecules described herein.

Both RIPs and fungal ribotoxins are inhibited by various small molecules. Non-limiting examples of small molecule inhibitors of the N-glycosidase activities of RIPs and fungal toxins include (1) nucleotides; (2) nucleic acids; (3) RNA aptamers; (4) small molecules discovered by high throughput screening; (5) ribosome stalk protein peptides; (6) rationally designed small molecules; and substrate or transition state mimics (see Skinner L, Jackson M, *J Bacteriol* 179: 1368-74 (1997); Pallanca et al., *Biochimica et Biophysica Acta* 1384: 277-84 (1998); Brigotti et al., *Life Sciences* 68: 331-6 (2000); Briggoti et al., *Nucl Acids Res* 28: 2383-8 (2000); Hirao I et al., *J Biol Chem* 275: 4943-8 (2002); Roday S et al., *Biochemistry* 43: 4923-33 (2004); McCluskey A et al., *J Mol Biol* 378: 375-86 (2008); Wahome P et al., *Toxicon* 56: 313-23 (2010); Jasheway K et al., *Toxins* 3: 1233-48 (2011); Pang Y et al., *PLoS One* 6: e17883 (2011); Preut J et al., *Eur J Med Chem* 46: 3608-15 (2011); Laruidsen L, Veedo R, *Nucleic Acid Ther* 22: 371-9 (2012); Pruet J et al., *ACS Med Chem Lett* 3: 588-91 (2012); Wahome P et al., *Curr Top Microbiol Immunol* 357: 179-207 (2012); Wiget P et al., *Bioorg Med Chem Lett* 23: 6799-804 (2013); Saito R et al., *J Med Chem* 56: 320-9 (2013); US 2011/0201674).

Nucleic acid type inhibitors include, e.g., RNAs, DNAs, DNA/RNA hybrids, and analogs of the aforementioned (Roday S et al., *Biochemistry* 43: 4923-33 (2004); Sturm M et al., *J Am Chem Soc* 129: 5544-50 (2007); Roday S et al., *Biochemistry* 46: 6169-82 (2007); Sturm M et al., *Biochemistry* 48: 9941-8 (2009)). For example, ricin has been shown to bind RNAs, DNA/RNA hybrids, circular DNAs, and RNA analogs (Chen X et al., *J Am Chem Soc* 122: 6109-17 (2000); Chen X et al., *J Am Chem Soc* 122: 6527-34 (2000); Amukele T, Schramm V, *Biochemistry* 43: 4913-22 (2004); Amukele T et al., *Biochemistry* 44: 4416-25 (2005)). Ricin inhibition has been shown with GAGA sequences and cyclic nucleic acids such as, e.g., d[G(N-Bn)GA, G(N-Bn)GA, d[G(N-Bn)G(N-Bn)] and PS d[G(N-Bn)G(7-deazaA)] (Sturm M et al., J Am Chem Soc 129: 5544-50 (2007)). Ricin inhibition has been shown with stem-loop RNAs, such as stem-loop RNAs which resemble the oxacarbenium ion transition state (Chen et al., *Biochemistry* 37: 11605-13 (1998); Tanaka K et al., *Biochemistry* 40: 6845-51 (2001)). In particular, 10-base RNA stem-loops incorporating 1,2-dideoxyribitol, 1,4-dideoxy-1,4-imino-D-ribitol, (1S)-1-(9-deazaadenin-9-yl)-1,4-dideoxy-1,4-imino-D-ribitol, and/or (3S,4R)-4-hydroxy-3-(hydroxymethyl)pyrrolidine with or without 9-deazaadenyl groups. Saporins are inhibited by RNA and DNA stem loop structures comprising the GAGA tetraloop motif and comprising modified bases such as adenine with 2'-OMe (US 2011/0201674). Because the substrate of most RIPs and ribotoxins is the universally conserved SRL structure of the ribosomes, many ribotoxic regions of the present invention will be inhibited by small synthetic oligoribonucleotides, RNAs, DNAs, DNA/RNA hybrids, stem-loops, tetramer loops, and derivatives of the aforementioned which mimic the SRL structure.

RNA aptamer type inhibitors include, e.g., 31RA and other aptamers inhibit ricin activity (Hesselberth J et al., *J Biol Chem* 275: 4937-42 (2000); Hirao I et al., *J Biol Chem* 275: 4943-8 (2000); Fan S et al., *World J Gastroenterol* 14: 6360-5 (2008)).

Small molecule inhibitors of RIPs include molecules of the following classes: azasugar mimics, purines, pterins, and dihydroxyamino-pyrmidines. Small molecule inhibitors include, e.g., 8-methyl-9-oxoguanine, 2-amino-4,6-dihydroxy-pyrimidines, (3S,4R)-3-hydroxy-4-(hydroxymethyl) pyrrolidine, 4-aminopyrazolo [3,4] pyrimidine (4-APP), 4-fluorophenyl methyl 2-(furan-2-yl) quinoline-4-carboxylate, 7-carboxy pterin (7CP), furan-linked pterins, triazol-linked pterins, 7-peptide-substituted pterins, 9-deazaadenine N-hydroxypyrrolidine sugars, cyclic oxime constructs with 9-deazaadenine N-hydroxypyrrolidine sugars, tetramer G(9-DA)GA 2'OMe, trimer G(9-DA)Gs3 2'-OMe, dimer s3(9-DA)Gs3 2'-OMe, and monomer s3(9-DA)s3-propyl phosphate (Yan X et al., *J Mol Biol* 266: 1043-49 (1997); Miller D et al., *J Med Chem* 45: 90-8 (2002); Roday S et al., *Biochemistry* 43: 4923-33 (2004); Bai Y et al., *Arch Biochem Biophys* 483: 23-8 (2009); Bai Y et al., *Toxicon* 56: 526-34 (2010); US 2011/0201674).

For example, adenosine isomers, such as adenine, 4-APP, and analogs thereof, exhibit strong inhibitory activity to ribosome inactivation activity by RIPs, such as barley RIP, bryodin, gelonin, luffin, momordin, PAP-S, ricin, saporin, and trichosanthin (Pallanca A et al., Biochim Biophys Acta 1384: 277-84 (1998); Brigotti et al., *Life Sciences* 68: 331-6 (2000); Bai Y et al., *Arch Biochem Biophys* 483: 23-28 (2009)). An adenine analog includes any fused bicyclic compound where one of the rings is 6-aminopyrimidine and the other ring is a 5-membered heterocyclic ring that contains at least two adjacent carbon atoms, such as pyrrole, pyrazole, imidazole, triazole, oxazole, isoxazole, thiazole, isothiazole, furan, or thiophene, among others such as 4-APP and formycin base amino substituted pyrazolo pyrimidines. Adenine analogs include nucleotides or nucleosides, such as deoxyribonucleotides, ribonucleosides, and deoxyribonucleosides.

For example, pterins, such as pteroic acid, inhibited the catalytic activity of the ricin A Subunit (Yan X et al., *J Mol Biol* 266: 1043-9 (1997)). Other inhibitors of ricin and Shiga toxins have been described, such as, e.g., small molecule inhibitors discovered by high-throughput screening (Miller D et al., *J Med Chem* 45: 90-8 (2002); Bai Y et al., *Arch Biochem Biophys* 483: 23-8 (2009); Stechmann B et al., *Cell* 141: 231-42 (2010); Wahome P et al., *Toxicon* 56: 313-23 (2010); Pang Y et al., *PLoS One* 6: e17883 (2011)). The small molecules R16, R16b, R19, R19b, R19c, R19d, R20, R20b, and R22 were each shown to be capable of inhibiting the enzymatic activity of both ricin and the Shiga toxin Stx2 and are predicted to inhibit the enzymatic activities of other RIPs. The small molecules R16, R16b, R19, R19b, R19c, R19d, R20, R20b, and R22 were each shown to be capable of inhibiting the enzymatic activity of both ricin and the Shiga toxin Stx2 and are predicted to similarly inhibit other RIPs (Pang Y et al., *PLoS One* 6: e17883 (2011)). The small molecules Retro-1 and Retro-2 inhibit ricin (Park J et al., *SREP* 2: 631 (2012); Noel R et al., *J Med Chem* 56: 3404-13 (2013)).

Inhibitors comprising other chemical platforms exist or may be identified by the skilled worker, such as, e.g., virtual or actual compound library screening (see Bai Y et al., *Toxicon* 56: 526-34 (2010)). For example, the ricin and Shiga toxin inhibitors CB5225540, CB5282931, CB5978818, CB7543758, and CB9062573 identified by certain virtual screening programs evinced little resemblance to most other RIP inhibitors (Bai Y et al., *Toxicon* 56: 526-34 (2010)).

In addition, it has been shown that many RIPs bind to ribosomal stalk proteins (Wong Y et al., *PLoS One* 7: e49608 (2012)). The ribosomal stalk is a dynamic structure of the large ribosomal subunit in proximity to the SRL in both prokaryotes and eukaryotes (Grela P et al., *J Mol Evol* 67: 154-67 (2008); Bernadó P et al., *Biophys J* 98: 2374-82 (2010); Grela P et al., *Biochemistry* 49: 924-33 (2010)). Shiga toxins and other RIPs like ricin and trichosanthin specifically bind a consensus polypeptide sequence in ribosomal stalk proteins (Hudak K et al., *J Biol Chem* 274: 3859-64 (1999); Chan D et al., *Nucleic Acids Res* 35: 1660-72 (2007); Chiou J et al., Mol Microbiol 70: 1441-52 (2008); McCluskey A et al., *J Mol Biol* 378: 375-86 (2008); Too P et al., Nucleic Acid Res 37: 602-10 (2009); Chiou J et al., *Int J Biochem Cell Biol* 43: 1792-1801 (2011); May K et al., *FEBS J* 279: 3925-36 (2012); McCluskey A et al., *PLoS One* 7: e31191 (2012)). Peptides corresponding to the domains in stalk proteins bound by RIP have been shown to inhibit Shiga toxins (McCluskey A et al., *J Mol Biol* 378: 375-86 (2008)).

Other small molecule inhibitors of RIPs are known in the art, or can be identified (see e.g. Wahome P, Mantis N, *Curr Protoc Toxicol*. Ch. 2: Unit 2.23 (2013); U.S. Pat. No. 6,562,969). These inhibitors can inhibit the glycosidase activity of the enzymatic domains and/or otherwise inhibit RIP toxicity.

The bacterial ribotoxins, cholix toxin, DT, and PE are inhibited by nicotinamide mimics, such as, e.g., PJ34, β-methylene-thiazole-4-carboxamide adenine dinucleotide (β-TAD$^+$), and ApUp (Li M et al., *Proc Natl Acad Sci USA* 93: 6902-6 (1996); Kahn K, Bruice T, *J Am Chem Soc* 123: 11960-9 (2001); Jorgensen R et al., *Nature* 436: 979-84 (2005); Yates S et al., *Biochem J* 385: 667-75 (2005)).

A non-ribotoxic screening environment may be created using an interfering antibody recognizing an antigen in the appropriate toxin and/or ribotoxic region. Toxins and toxin enzymatic domains can be inhibited by immunoglobulins and immunoglobulin domains, particularly those capable of occluding an enzymatic active site or preventing substrate binding. Because of the relevance of recombinant DNA techniques and in vitro library screening in the generation of immunoglobulin-type binding regions, immunoglobulins and immunoglobulin domains can be redesigned to obtain desired characteristics, such as smaller size, cell entry, or other therapeutic improvements.

The A chain of ricin, the enzymatic subunit, is neutralized or blocked by several monoclonal antibodies, such as e.g. mAb 6C2, 6G3, 13C10, 13G6, 2D6, RAC mAb 1-23, 23D7, 25A4, RTA 1-18, RTA 24-394, RiVax, RTA 1-33/44-198, GD12, SyH7, PB10, R70, SB1, RA36, IB2, WECB2, TB12, PA1, PH12, humanized GD12, single-chain monoclonal antibodies VHHs (e.g. RTA-F5, RTA-G12, RTA-D10, RTA-E5, and RTA-G11), and the scFv 43RCA (Foxwell B et al., *Toxicology* 34: 79-88 (1985); Colombatti M et al., *Hybridoma* 5: 9-19 (1986); Lemley P et al., *Hybridoma* 13: 417-21 (1994); Maddaloni M et al., *J Immunol* 172: 6221-8 (2004); Dertzbaugh M et al., *Hybridoma* 24: 236-43 (2005); Mantis N et al., *Infect Immun* 74: 3455-62 (2006); Carra J et al., *Vaccine* 25: 4149-58 (2007); Smallshaw J et al., *Vaccine* 25: 7459-69 (2007); Pelat et al., *BMC Biotechnol* 9: 60 (2009); Neal L et al., *Infect Immun* 78: 552-61 (2010); O'Hara J et al., *Vaccine* 28: 7035-46 (2010); Dai J et al., *J Biol Chem* 286: 12166-71 (2011); Prigent J et al., *PLoS One* 6: e20166 (2011); O'Hara J et al., *Vaccine* 30: 1239-43 (2012); Song K et al., *PLoS One* 8: e62417 (2013); Thomas J et al., *Hum Vaccin Immunother* 9: 744-52 (2013); Vance D et al., *J Biol Chem* 288: 36538-47 (2013); Zhu Y et al., *J Biol Chem* 288: 25165-72 (2013); O'Hara J et al., *Immunol Lett* 158: 7-13 (2014); Rudolph M et al., *J Mol Biol* 426: 3057-68 (2014)). Most ricin toxin neutralizing antibodies bind the A chain of ricin instead of the B chain (Foxwell B et al., *Toxicology* 34: 79-88 (1985); Lemley P et al., *Hybridoma* 13: 417-21 (1994); Maddaloni M et al., *J Immunol* 172: 6221-8 (2004); Song K et al., *PLoS One* 8: e62417 (2013)). The murine monoclonal antibodies GD12, R70, PB10, and SyH7 inhibit ricin enzymatic activity in vitro (O'Hara J et al., *Vaccine* 28: 7035-46 (2010)). SyH7 binds an arginine rich positively charged patch that has been proposed to make contact with rRNA region important for substrate binding and located between the primary and secondary adenine-specificity binding pockets of ricin (Katzin N et al., *Proteins* 10: 251-9 (1991); Li X et al., *Biochemistry* 48: 3853-63 (2009)). GD12 binds near the active site (Neal L et al., *Infect Immun* 78: 552-61 (2010)). R70 binds an alpha helix that might be involved in enzymatic activity (Lebeda F, Olson M, *Int J Biol Macromol* 24: 19-26 (1999); Neal L et al., *Infect Immun* 78: 552-61 (2010); Dai J et al., *J Biol Chem* 286: 12166-71 (2011)). The mouse monoclonal antibody mAb 6C2 strongly neutralizes ricin toxin, and this neutralizing activity may be due to inhibition of ribosome docking because mAb-6C2 binding was mapped to the amino acid positions 96-116 of ricin (Zhu Y et al., *J Biol Chem* 288: 25165-72 (2013)). RAC14, RAC18 and RAC23 both block ricin enzymatic activity in vitro, and RAC18 has effective neutralizing activity in vivo (Maddaloni M et al., *J Immunol* 172: 6221-8 (2004); Pratt T et al., *Exp Lung Res* 33: 459-81 (2007); Roche J et al., *Lab Invest* 88: 1178-91 (2008)).

The A Subunit of Shiga toxins are bound by several antibodies, such as the monoclonal antibodies MAb 11F11, MAb 11G10, MAb 2E1, MAb 10E10, Hu-MAb 7E12, MAb 11E10, 5C12, MAb DC1 EH5, MAb GB6 BA4, humanized 11E10 cαStx2, HuMAb 5C12, HuMAb 5H8, HuMAb 3E9, HuMAb 2F10, HuMAb 1G3, HuMAb 4H9, HuMAb 5A4, Stx2-1, and MAb S2C4 (Stockbrine N et al., *Infect Immun* 50: 695-700 (1985); Downes F et al., *Infect Immun* 56: 1926-33 (1988); Perera L et al., *J Clin Microbiol* 26: 2127-31 (1988); Mukherjee J et al., *Infect Immun* 70: 612-9 (2002); Mukherjee J et al., *Infect Immun* 70: 5896-9 (2002); Sheoran A et al., *Infect Immun* 71: 3125-30 (2003); Krautz-Peterson G et al., *Infect Immun* 76: 1931-9 (2008); Jiao Y et al., *Prog Biochem Biophys* 36: 736-42 (2009); Smith M et al., *Infect Immun* 77: 2730-40 (2009); Guo X et al., *J Med Mol Biol* 5: 382-7 (2010); Rocha L et al., *Toxins* 4: 729-47 (2012); Cheng L et al., *Toxins* 5: 1845-58 (2013); He X et al., *J Immunol Methods* 389: 18-28 (2013); US). Many of these antibodies exhibit neutralizing and/or protective characteristics (Krautz-Peterson G et al., *Infect Immun* 76: 1931-9 (2008); Jeong K et al., *BMC Immunol* 11: 16 (2010)). For example, the in vitro enzymatic activity of Stx2A is inhibited by the mouse monoclonal antibody 11E10 (Smith M et al., *Infect Immun* 77: 2730-40 (2009); Rocha L et al., *Toxins* 4: 729-47 (2012)). Stx2A is bound by the neutralizing mouse monoclonal antibodies 11E10 and S2C4, whose epitopes were mapped (Jiao Y et al., *Progress in Biochem Biophys* 36: 736-42 (2009); Smith M et al., *Infect Immun* 77: 2730-40 (2009); Guo X et al., *J Med Mol Biol* 5: 382-7 (2010); Rocha L et al., *Toxins* 4: 729-47 (2012); Jaio Y et al., *PLoS One* 9: e88191 (2014)).

The A Subunit of abrin is neutralized by the mouse monoclonal antibody mAb D6F10, which binds at the amino acid residue positions 74-123 near the active site cleft (Surendranath K, Karande A, *Clin Vaccine Immunol* 15: 737-43 (2008); Bagaria S et al., *PLoS One* 8: e70273 (2013)). At lower inhibitory concentrations, this antibody may still allow for internalization screening (Surendranath K, Karande A, *Clin Vaccine Immunol* 15: 737-43 (2008); Bagaria S et al., *PLoS One* 8: e70273 (2013)). The A Subunit of abrin-a is bound by the monoclonal antibody mAb 4G1 (Li X et al., *J Agric Food Chem* 59: 9796-9 (2011)), which may exhibit inhibitory activity towards the ribotoxicity of abrin ribotoxic regions.

*Pseudomonas* exotoxin A is bound by many antibodies such as Ex-3C7, Ex-4F2, Ex-8H5, and Ex-2A10 (Ohtsuka H et al., *Infect Immun* 60: 1061-8 (1992); Elzaim H et al., *Infect Immun* 66: 2170-9 (1998)). For example, Ex-2A10 inhibits enzymatic activity (Ohtsuka H et al., *Infect Immun* 60: 1061-8 (1992)). A rabbit neutralizing antibody binds PE enzymatic 626-638 (H) and interferes with PE enzymatic activity (Elzaim H et al., *Infect Immun* 66: 2170-9 (1998)). A mouse monoclonal antibody 2A10 binds PE and interferes with its enzymatic activity (Elzaim H et al., *Infect Immun* 66: 2170-9 (1998)).

The A Subunit of diphtheria toxin is bound by many antibodies, such as MAb-AC5, 83B8, and hMAbs 3B2F3, 512C5, 3B4G1, 54E2, 57G3, 513G3, 56E6, and 513A1 (Zucker D, Murhpy J, *Mol Immunol* 21: 785-93 (1984); Rolf J, Eidels, L, *Infect Immun* 61: 994-1003 (1993); Usuwanthim K et al., *Asian Pac J Allergy Immunol* 26: 47-55 (2008); Sevigny L et al., *Infect Immun* 81: 3992-4000 (2013)). For example, mAb AC5 might inhibit DT enzymatic activity (Usuwanthim K et al., *Asian Pac J Allergy Immunol* 26: 47-55 (2008)).

Additional molecular inhibitors of ribotoxic regions may be created, identified, or obtained. For example, other antibodies, antibody derivatives, and immunoglobulin domain constructs may be created, identified, or obtained. Other small molecule inhibitors may be generated, such as e.g. aptamers, peptides, and small molecules (Tang J et al., *Biosens Bioelectron* 22: 2456-63 (2007)).

The amount of inhibitor used in these methods of display screening is known to the skilled worker and can also be empirically determined. For example, 4-APP is typically effective for cell surface display screening at concentrations of about 0.1 millimolar (mM) to 50 mM. It is understood that the concentration of the inhibitor may be varied depending on the type of display screening, e.g. in vitro versus cell surface, prokaryotic versus eukaryotic, the conditions, the duration, and/or the particular ribotoxic region to be inhibited.

For cell surface display screening, a non-ribotoxic screening environment may be created using a modified host strain which produces an inhibitor of the appropriate ribotoxic region. In yeast, expression of truncations of the ribosomal protein L3 can reduce and/or eliminate Shiga toxin toxicity (US 2010/0298238). Yeast stains with the mak8-1 genotype are more resistant to RIP toxicity (Mansouri S et al., *RNA* 12: 1683-92 (2006)).

IV. The General Operation of Methods of Screening Ribotoxic Polypeptides Based on the Interim Diminution of Ribotoxicity The present invention provides various methods for improved molecular display screening of ribotoxic, recombinant proteins and polypeptides, e.g. immunotoxins, ligand-toxin fusions, immuno-RNases, and toxin variants comprising synthetic peptide, targeting domains. The methods of the invention enable one-step screening for cytotoxic polypeptides and molecular frameworks comprising at least two functional regions: a cell-targeting region and a ribotoxic effector region. The screening methods of the invention enable the optimization of multiple functional regions simultaneously, instead of the less desirable piecemeal approach involving isolating the toxin functional region.

The present invention overcomes the problems caused by the presence of ribotoxic polypeptides by screening in the context and/or environment where the activity of the library ribotoxic component is temporarily reduced or eliminated. The reduction or elimination of ribotoxicity may be accomplished in at least two ways: 1) by using a non-ribotoxic form of the toxin region caused by one or more mutations, and/or 2) by performing the screening and/or selecting in the presence of an inhibitor molecule of the appropriate toxin region.

A. The Presence of Ribotoxic Polypeptides while Screening is Problematic

The presence of ribotoxic molecules in expression libraries might perturb display screening using any protein display method because all protein display technologies depend on ribosomes. For example, cell surface display technologies directly involve living cells, such as microorganism display (e.g. bacterial, fungi) and mammalian cell display. The presence of ribotoxic molecules in expression libraries might dramatically perturb these systems. Display technologies that do not require cells, such as bacteriophage display and virus display, still indirectly involve living cells as intermediaries to express the protein display library and recover the genotypes of selected members. Again, the presence of ribotoxic molecules in expression libraries might perturb these systems, such as, e.g., by introducing unwanted biases away from the most toxic members of libraries.

In addition, fully in vitro display methods, such as RNA display, ribosome display, and protein-DNA linkage display also utilize ribosomes, at least for an expression step, which can be perturbed by the presence of ribotoxic members of expression libraries thereby resulting in undesirable selection biases. Any protein display method which requires an in vitro translation step involving ribosomes is susceptible to perturbation by the presence of ribotoxic polypeptides. The translation steps of in vitro display methods often utilize semi-purified or purified ribosomes from both prokaryotic and eukaryotic sources, e.g. the E. coli S30 system, rabbit reticulocyte lysates, or wheat germ lysates (see e.g. PURE Express and PURESYSTEM from Wako Pure Chemical Industries (Osaka, Japan); Ueda T et al., *Methods Mol Biol* 607: 219-25 (2010)).

Thus, most if not all, protein display technologies require functioning ribosomes to operate properly and might be perturbed by the presence of ribotoxic library members. Perturbations caused by the presence of ribotoxicities in the library might prevent any screening altogether or produce a new selective pressure stronger than any of the designed selection criteria—the pressure to nullify the ribotoxicity via spontaneous mutation, such as, e.g., point mutations, deletions, insertions, inversions, truncations caused by premature stop codons, frame shifts, and/or recombination events. Even if the presence of ribotoxicity produced only a weak and undesired selective pressure against the most ribotoxic members of the library, this would add an unwanted selection bias against some of the most desired hits in the screen, i.e. the most ribotoxic members.

Furthermore, high-throughput screening of large protein libraries requires relatively equivalent ribosome function from genotype to genotype within the library to avoid the systemic introduction of unwanted biases. Perturbing ribosome function before screening can introduce biases into the representation of members of the library which would bias the results of the screen, such as, e.g., obscuring some positive hit genotypes (false negatives) and introducing false positives (see Examples, infra). It is predicted that the presence of ribotoxicity would generate multiple biases away from the most ribotoxic members, such as, e.g., biased library representation, biased selections, and biased efficiency in recovery steps involving ribosomes.

B. Screening, Selecting, and Enriching Libraries of Cytotoxic Recombinant Polypeptides Based on the Interim Reduction of Ribotoxicity The present invention provide methods of screening, selecting, and identifying cytotoxic polypeptides with specific characteristics based on the interim reduction or elimination of ribotoxicity and based on one or more selectable characteristics such as, e.g., target biomolecule binding affinity, target cell binding affinity, and/or target cell internalization. The methods of the invention allow for the one step selection of chimeric cytotoxic proteins and polypeptides in the context of a completely chimeric molecule while minimizing unwanted selection biases caused by the presence of ribotoxicity. Thus, polypeptides which have desired expression, stability, and other production characteristics in the context of the final, chimeric, protein or polypeptide can be identified in a single screening step simultaneously while selecting for other desired characteristics, such as, e.g., binding affinity. These methods provide for efficient, effective, and powerful screening by protein display technologies which enable the screening of relatively diverse polypeptide libraries, such as, e.g., RNA display, phage display, and ribosome display.

The reduction or elimination of ribotoxicity is accomplished in at least two ways: 1) by using a non-ribotoxic form of the toxin region caused by one or more mutations, and/or 2) by performing the screening and/or selecting in the presence of an inhibitor molecule of the appropriate toxin region. Thus, one method of the invention involves a modified ribotoxic region that is modified from the ribotoxic region by at least one amino acid substitution, deletion, insertion, and/or addition, such that the modified ribotoxic region has reduced or eliminated ribotoxicity. Once a polypeptide is identified in the screen, a more ribotoxic variant of the polypeptide may be created to undo the reduction or elimination of ribotoxicity. A second method of the invention involves performing production, selection, and/or recovery of displayed polypeptides in the presence of an inhibitor of the appropriate ribotoxic region.

The screening methods of the invention may be used to identify chimeric cytotoxic polypeptides comprising cell-targeting binding regions fused with fully ribotoxic, ribotoxic regions. These chimeric cytotoxic polypeptides have uses for, e.g., targeted cell-killing and as therapeutics in the treatment of a variety of diseases, disorders, and conditions, including cancers, immune disorders, and microbial infections.

Screening may be performed to discover or improve the binding region of a chimeric cytotoxic polypeptide. The linking of cell targeting binding regions with ribotoxic regions enables the engineering of cell-type specific targeting of potent natural toxin cytotoxicity. In order for chimeric cell-targeting toxins to be therapeutically useful, the cytotoxic recombinant polypeptide must preferentially bind and enter a particular cell type(s). Once in the cells, at least some portion of the internalized cytotoxic polypeptide must be capable of getting at least a portion of the ribotoxic region to the cytosol to inactivate ribosomes. In particular, two important characteristics may be screened for in order to identify a cytotoxic polypeptide or further optimize a framework: 1) target binding affinity and specificity and 2) target cell entry. Screening for these characteristics enables the design of polypeptides which selectively kill specific cell types. Often, the goal of screening is to identify binding regions comprising polypeptide regions capable of binding specifically to an extracellular target biomolecule which is physically-coupled to the surface of a cell type of interest, such as, e.g., a cancer cell, tumor cell, plasma cell, infected cell, or host cell harboring an intracellular pathogen.

The present invention provides methods of screening, selecting, and identifying cytotoxic polypeptides with specific characteristics based on the interim reduction or elimination of ribotoxicity. The methods of the present invention enable screening and selecting chimeric polypeptides, each with a binding region and a toxin region, for desired characteristics and in the context of both polypeptide regions to account for interregional interactions and one-step optimization. Highly diverse libraries of chimeric polypeptides may be screened using powerful display screening methods, such as, e.g., phage display, ribosome display, RNA display, DNA linkage display, and bacterial display (see e.g. WO 1998/031700; WO 2000/047775; U.S. Pat. Nos. 6,207,446; 6,214,553; 6,258,558; 6,261,804; 6,281,344; US 2003/0186374, US 2004/0180422).

Chimeric cytotoxic polypeptides of the invention may be screened or selected based on numerous criteria, such as, e.g., target binding affinity, target binding selectivity, cell binding affinity, cell binding selectivity, cellular internalization, improved stability, improved solubility, improved pharmacokinetic properties, improved pharmacodynamic properties, improved, expression in a laboratory species or cell line, and/or reduced antigenicity and/or immunogenicity. For example, chimeric polypeptides can be selected-for binding regions with target biomolecules which have cell-type specific expression and/or the physical localization with specific cell types. For example, certain cytotoxic polypeptides of the present invention comprise binding domains capable of binding cell-surface targets which are expressed exclusively by only one cell-type to the cell surface. This permits the targeted cell-killing of specific cell types with a high preferentiality over "bystander" cell types that do not express the extracellular target biomolecule.

Alternatively, the expression of the target biomolecule of the binding region may be non-exclusive to one cell type if the extracellular target biomolecule is expressed in low enough amounts and/or physically coupled in low amounts with cell types that are not to be targeted. This also permits the targeted cell-killing of specific cell types with a high preferentiality over "bystander" cell types that do not express significant amounts of the extracellular target biomolecule or are not physically coupled to significant amounts of the extracellular target biomolecule. Other characteristics of the cytotoxic polypeptides of the invention may be selected for in order to optimize the cytotoxic polypeptides for use in different, specialized environments, such as ex vivo, in vitro cultured, or in vivo—including cells in situ in their native locations within a multicellular organism.

B. Screening, Selecting, and Enriching Using Non-Ribotoxic Templates

One embodiment of the invention is a method for identifying one or more cytotoxic proteins, wherein the cytotoxic protein comprises (1) a ribotoxic region comprising a polypeptide and capable of inactivating a ribosome, and (2) a binding region comprising a polypeptide capable of binding at least one target biomolecule, and, wherein the method comprises the steps of: (a) providing a plurality of proteins, each molecule comprising: (1) a binding region capable of binding at least one target biomolecule and (2) a modified ribotoxic region that is modified from said ribotoxic region by at least one amino acid substitution, deletion, insertion, or addition, such that the modified ribotoxic region has reduced or eliminated ribotoxicity; (b) selecting from among the plurality of proteins for a protein with at least one assay-selectable characteristic; and (c) identifying the amino acid sequences of the polypeptide regions of a selected protein in order to construct one or more ribotoxic proteins deriving from or comprising the identified binding region associated with a more ribotoxic form of said modified ribotoxic region.

Another embodiment of the invention is a method for identifying one or more cytotoxic fusion polypeptides, wherein the cytotoxic fusion polypeptide comprises: (1) a ribotoxic region capable of inactivating a ribosome and (2) a binding region capable of binding at least one target biomolecule and, wherein the method comprises the steps of: (a) providing an expression library of diverse nucleic acids constructed from a plurality of polynucleotides capable of encoding a plurality of fusion polypeptides, each fusion polypeptide comprising: (1) a binding region capable of binding at least one target biomolecule and (2) a modified ribotoxic region that is modified from said ribotoxic region by at least one amino acid substitution, deletion, insertion, or addition, such that the modified ribotoxic region has reduced or eliminated ribotoxicity, (b) expressing the expression library of diverse nucleic acids such that a plurality of fusion polypeptides are produced, (c) selecting from among the produced fusion polypeptides for an expressed fusion polypeptide with a specific characteristic, and (d) identifying a selected fusion polypeptide sequence in order to construct one or more cytotoxic fusion polypeptides comprising said binding region fused to a toxic form of said modified ribotoxic region.

After selection, the encoded polypeptide may be produced through transforming a host cell with at least one member of the expression library, or with an expression vector into which the polynucleotide encoding the polypeptide has been operably inserted, and expressing the encoded polypeptide in the host cell. There are many suitable alternative expression vectors and host cells for this production known in the art. For example, the cytotoxic polypeptide can be produced in production systems, known to the skilled worker, that are designed to shield the toxic portion from the host cell, thus allowing a host cell to produce a protein that would, without the engineering, be bactericidal.

A further possible step in the method of the present invention is the fusion of the selected binding region to an unmodified form of the ribotoxic region and expression of this derivative cytotoxic polypeptide. This is because the goal of the methods of the present invention will commonly be the production of a cytotoxic polypeptide that has the ability to kill the cancer cell as well as selectively bind the target molecule. Thus, once the candidate binder has been selected, the genetic alteration utilized to make the ribotoxic region non-toxic can be optionally reversed, restoring the toxic nature to molecule, and producing a derivative of the cytotoxic polypeptide that was particularly selected. The present invention contemplates the restoration of toxicity through any means, although restoration of those particular amino acid residues or sequences to a wild-type form (for example, those sequences encoding amino acids known to be involved in catalysis) are particularly contemplated.

Among cytotoxic fusion polypeptides with toxin regions derived from certain classes of toxins, specific restorative mutations are contemplated. Among cytotoxic fusion polypeptides derived from cholix toxins, restoration of the glutamic acid at position 148 of DT, 581 of cholix toxin, and 553 of PE are contemplated derivatives. Among cytotoxic fusion polypeptides with toxin regions derived from fungal ribotoxins and/or RNases, restoration of mutations in one or more of the core three conserved key amino acids residues important for catalysis as described herein, e.g., two histidine residues and a glutamate residue, are contemplated derivatives. Among cytotoxic fusion polypeptides with toxin regions derived from the RIP family of toxins, restoration of mutations in one or more of the core five conserved key amino acids residues important for catalysis as described herein, e.g., two tyrosine residues near the amino terminus of the catalytic domain, a glutamate and arginine near the center of the catalytic domain, and a tryptophan, are contemplated derivatives. Specifically, restoration of the tryptophan residue at position 77 and/or the glutamate residue at position 167 in the A Subunits of the Shiga toxins; the tyrosine residue at position 80, the glutamate residue at position 177, the arginine residues at positions 180 and 213, and/or the serine reside at position 203 in the A-chain of ricins; the histidine residue at position 137 in α-sarcins; the glutamate residue at position 176, and/or the arginine residue at position 179 in the A Subunits of saporins; the glutamate residue at position 164 and/or the arginine at position 167 in the A Subunits of abrins, the tyrosine residue at position 70, the glutamate residue at position 160, the arginine residue at position 163, and/or the tryptophan residue at position 192 in trichosanthins; the histidine residues at positions 49 and 136, the glutamate residue at position 95, and/or the arginine at position 120 in mitogillin; the tyrosine residue at position 47 and/or the histidine residues at positions 49 and 136 in restrictocin; the tryptophan residues at positions 50 and 153, the tyrosine residue at position 65, and/or the aspartate residue at position 148 in diphtheria toxins are contemplated derivatives.

Other alterations to the wild-type polypeptide sequence that are less essential to the catalytic function of a ribotoxic region may optionally be maintained in the produced, derivative cytotoxic polypeptide and production of such molecules are contemplated as being within the optional method step.

C. Screening, Selecting, and Enriching in the Presence of a Molecular Inhibitor of Ribotoxicity One embodiment of the present invention is a method for identifying one or more cytotoxic proteins, wherein the cytotoxic protein comprises: (1) a ribotoxic region comprising a polypeptide and capable of inactivating a ribosome, and (2) a binding region comprising a polypeptide and capable of binding at least one target biomolecule, and, wherein the method comprises the steps of: (a) providing a plurality of proteins, each protein comprising: (1) a ribotoxic region comprising a polypeptide and capable of inactivating a ribosome and (2) a binding region comprising a polypeptide and capable of binding at least one target biomolecule; (b) selecting from among the plurality of proteins for one or more proteins with at least one assay-selectable characteristic in the presence of an inhibitor of the ribotoxic region; and (d) identifying the amino acid sequences of the polypeptide regions of a selected protein.

Another embodiment of the invention is a method for identifying one or more cytotoxic fusion polypeptides, wherein the cytotoxic fusion polypeptide comprises: (1) a ribotoxic region capable of inactivating a ribosome and (2) a binding region capable of binding at least one target biomolecule and, wherein the method comprises the steps of: (a) providing an expression library of diverse nucleic acids constructed from a plurality of polynucleotides capable of encoding a plurality of fusion polypeptides, each fusion polypeptide comprising: (1) a binding region capable of binding at least one target biomolecule and (2) a ribotoxic region capable of inactivating a ribosome, (b) expressing the expression library of diverse nucleic acids such that a plurality of fusion polypeptides are produced, (c) selecting from among the produced fusion polypeptides for an expressed fusion polypeptide with a specific characteristic in the presence of an inhibitor of the ribotoxic region, and (d) identifying a selected fusion polypeptide sequence comprising said binding region fused with said ribotoxic region.

As referred to herein, a ribotoxic region "inhibitor" is any chemical, composition, or compound that inhibits the ribotoxicity of a ribotoxic region, such as measured by an enzymatic activity assay, e.g., in vitro ribosome inhibition. Typically, inhibitors reduce the N-glycosidase activity of RIPs, the ADP-ribosylation activity of cholix toxins, and/or the RNase activity of fungal ribotoxins. The term ribotoxic region inhibitor includes small molecules, such as, e.g., nucleosides, nucleotides, peptides, nucleic acids, polypeptides, immunoglobulin domains, immunoglobulins, and chemicals like 4-aminopyrazolo[3,4-d]pyriminidine (4-APP). The inhibition of certain ribotoxic activities during the screening steps may be accomplished via the addition or expression of a peptide, polypeptide, or immunoglobulin domain, as well as via the use of host cells with mutant genotypes that affect the levels of certain nucleosides, nucleotides, peptides, nucleic acids such as ribosomal RNAs, polypeptides, and/or proteins such as ribosomal proteins, which contribute to the system avoiding inactivation of at least a portion of the ribosomes present during screening steps.

The amount or concentration of inhibitor used must be sufficient to inhibit the ribotoxicity of a ribotoxic region such that in the presence of the inhibitor the ribotoxic region exhibits a reduction in ribotoxic activity by an appropriate assay for the ribotoxic region, such as an assay known to the skilled worker. For example. a ribotoxic region activity may be inhibited in the assay such that the enzymatic activity of the ribotoxic region is 30%, 40%, 50%, 60%, 70%, 80%, 90%, 91%, 92%, 93%, 94%, 95%, 96%, 97%, 98%, 99%, or 100% compared to the activity of the ribotoxic region in the same assay in the absence of the inhibitor.

D. Protein Display Screening

In general, protein display screening includes the steps of 1) preparing a molecular library composed of diverse members, 2) expressing a molecular library of polypeptides, 3) screening the polypeptides for a biological characteristic, and 4) identifying putative, characteristic-positive polypeptides.

The first step typically involves creating or acquiring an expression library composed of diverse nucleic acids (genotypes) capable of encoding varied polypeptide sequences. Then, the expression library is expressed such that the polypeptides of the library are displayed while maintaining a physical connection to the nucleic acid which encoded it (i.e. its genotype). To display means a polypeptide is accessible to bind or be bound to molecules in solution or immobilized on a stationary platform, microbead, and/or cell surface (see e.g. Diamante L et al., *Protein Eng Des Sel* 26: 713-24 (2013)). This enables various screening steps to be performed on the displayed library polypeptides to select for desired characteristics, i.e. phenotypes. When a displayed polypeptide with a desired phenotype is "hit" in the screen, then the physically coupled genotype can be recovered to identify the polypeptide sequence conferring that phenotype. In addition, the genotype (a particular nucleic acid clone) may be used to 1) produce the polypeptide for individualized study and/or 2) propagate the clone as a member of a library for subsequent library screening.

Screening cycles may be iteratively performed on a library in order to better identify polypeptides with desired properties. For example, an initially very complex library can be reduced in complexity by iterative rounds of screening selecting, enriching, and/or "biopanning." Similarly, a collection of diverse synthetic polypeptides may be subjected to in vitro evolution by iterative cycles of protein display screening and mutagenesis. During each round of screening, members of the library with the most fitness are preferentially enriched while less-fit molecules are preferentially lost resulting in more and more enriched libraries each cycle as both their molecular sequences change and their representation change overtime with iterative selection steps.

In addition, multiple selection sorting criteria may be used simultaneously or consecutively to select for multiple characteristics at the same time. For example, multiple rounds of screening using different selection criteria may be used on an already enriched subset of an original library in order to select for a different characteristic than already selected for in a previous screening step.

In display screening the quality, complexity, composition, and size of the library are critical to its effectiveness because only an existent member may be selected and recovered by screening. Commonly, the goal is to have expression libraries as large and diverse as possible such that the library's expressed polypeptide members are highly heterogeneous in their polypeptide sequences. Complexity in the expression library is commonly achieved by mutagenesis and/or combinatorial assembly of the nucleic acids encoding the library using sequence-randomized synthetic nucleic acids and/or nucleic acid fragment recombination/shuffling.

The binding regions of the proteins and polypeptides of the present invention may be derived from various polypeptide sequences, such as, e.g., from ligands, immunoglobulins, immunoglobulin domains, engineered antibody derivatives, and engineered alternatives to antibodies. Immunoglobulin-type binding regions may be derived from native immunoglobulins, semi-synthetic immunoglobulins, synthetic immunoglobulins, or engineered alternatives to antibodies (Tohidkia M et al., *J Drug Target* 20: 195-208 (2012); de Marco A, *Crit Rev Biotechnol* 33: 40-8 (2013)). Thus, the expression libraries of the present invention which encode the polypeptides used for screening may be derived from these same sources.

Polynucleotides encoding immunoglobulins and/or immunoglobulin domains may be obtained from immunoglobulin repertoires of immunized or non-immunized chordate donors (Bradbury A, Marks J, *J Immunol Methods* 290: 29-49 (2004); Harel Inbar N, Benhar I, *Arch Biochem Biophys* 526: 87-98 (2012)). Immunoglobulin encoding DNAs or RNAs may be obtained from immunized chordate donors, such as, e.g., camelids, rabbits, rodents, or sharks, (see e.g. Lonberg N et al., *Nat Biotechnol* 23: 1117-25 (2005); Kim S et al., *J Immunol Methods* 329: 176-83 (2008); Muyldermans S et al., *Vet Immunol Immunopathol* 128: 178-83 (2009); Bell A et al., *Cancer Let* 289: 81-90 (2010); Cheong C et al., *Blood* 116: 3828-38 (2010); Moon S et al., *Mol Cells* 31: 509-13 (2011); Zhu C et al., *J Immunol* 187: 2492-501 (2011); Tarr A et al., *Heptaology* 58: 932-9 (2013)). Immunoglobulin encoding DNAs or RNAs may be obtained from the immune cells of human patients, such as, e.g., after exposure to an immunogen from a cancer, tumor, or microorganism (see e.g. Larralde O et al., *J Virol Methods* 140: 49-58 (2007); Kalnina Z et al., *J Immunol Methods* 334: 37-50 (2008); Zhao A et al., *J Immunol Methods* 363: 221-32 (2010); Xin L et al., *Front Biosci* (Landmark ed) 18: 765-72 (2013)). Chordates may be intentionally immunized with an antigen and/or immunogen, such as, e.g., with a protein, polypeptide, or peptide from a desired target protein, proteoglycan, lipid, glycolipid, carbohydrate, tumor cell, or intracellular pathogen. For example, chordates may be immunized with specific cancer cells in order to identify immunoglobulin domains which bind specifically to those cells (see e.g. Baral T et al., *J Immunol Methods* 371: 70-80 (2011)). Animals genetically modified with human immunoglobulin genetic sequences enable for the easier creation of humanized immunoglobulins, such as, e.g., by using transgenic rabbits expressing human neonatal Fc receptors (Kacskovics I et al., *MAbs* 3: 431-9 (2011)). In addition, fully human immunoglobulin repertoires and monoclonal immunoglobulins can be generated from immunized transgenic mice expressing human antibody gene sequences (Lonberg N, *Curr Opin Immunol* 20: 450-9 (2008); Schultz L et al., *Nat Rev Immunol* 12: 786-98 (2012)).

Large libraries with immunoglobulin derived binding regions may be derived from immunized, unimmunized, or synthetic sources. Combinatorial methods of library construction enables the generation of larger and more diverse synthetic or semi-synthetic libraries in order to explore a larger repertoire of binding regions. Combinatorial polynucleotide libraries can be constructed from the nucleic acid sequences encoding immunoglobulins from immunized donors or non-immunized donors, also known as naïve or unbiased sources (Harel Inbar N, Benhar I, *Arch Biochem Biophys* 526: 87-98 (2012)). For example, protein display screening can be performed on large, synthetic or semi-synthetic libraries comprising immunoglobulin derived sequences using molecular biology techniques to engineer diversity around a given immunoglobulin domain, immunoglobulin, or immunoglobulin repertoire (Hoogenboom H, Winter G, *J Mol Biol* 227: 381-8 (1992); Barbas C et al., *Proc Natl Acad Sci USA* 89: 4457-61 (1992); Marks J et al. *J Mol Biol* 222: 581-97 (1991); van Wyngaardt W et al., *BMC Biotechnol* 4: 6 (2004); Deschacht N et al., *J Immunol* 184: 5696-704 (2010)). In addition, immunoglobulin development can now be accomplished without a chordate immune system by using synthetic libraries (see e.g. Bradbury A et al., *Nat Biotechnol* 29: 245-54 (2011)).

In addition to immunoglobulin-derived polypeptides, other polypeptide-based binding domains have been engineered, some of which have been referred to as antibody mimics or scaffolds (Wörn A, Plückthun A, *J Mol Biol* 305: 989-1010 (2001); Xu L et al., *Chem Biol* 9: 933-42 (2002); Wikman M et al., *Protein Eng Des Sel* 17: 455-62 (2004); Binz H et al., *Nat Biotechnol* 23: 1257-68 (2005); Holliger P, Hudson P, *Nat Biotechnol* 23: 1126-36 (2005); Gill D, Damle N, *Curr Opin Biotech* 17: 653-8 (2006); Koide A, Koide S, *Methods Mol Biol* 352: 95-109 (2007); Zoller F et al., *Molecules* 16: 2467-85 (2011)). These engineered immunoglobulin-type binding domains are relatively small in size and capable of exhibiting high affinity and specific binding to a wide range of target molecules similar to antibodies. For example, human fibronectin based scaffolds were used in RNA display methods to identify binders to a human vascular endothelial growth factor receptor (VEGFR) from a naïve library of $10^{13}$ members and with binding affinities of up to a dissociation constant of 60 picomolar (Getmanova E et al., *Chem Biol* 13: 549-56 (2006)); in yeast display from a library of $10^8$ members to find binders of human EGFR with a dissociation constant up to 51 picomolar (Hackel B, Wittrup K, *Protein Eng Des Sel.* 23: 211-9 (2010)), and in phage display to find binders to Abl SH2 of up to a dissociation constant of 7 nanomolar (Wojcik J et al., *Nat Struct Mol Biol* 17: 519-27 (2010)).

There are various methods for introducing diversity into a molecular library, such as by combinatorial construction, mutation, and genetic recombination (see Miersch S, Sidhu S, *Methods* 57: 486-98 (2012)). For example, mutation may be accomplished by growth in mutator *E. coli* strains, DNA shuffling, error prone PCR, site-directed mutagenesis, cassette mutagenesis, polynucleotide module shuffling, cosmixplexing, and/or randomly varied polynucleotide components such as trinucleotide variants (see e.g. Stemmer W, *Nature* 370: 389-91 (1994); Virnekäs B et al., *Nucleic Acids Res* 22: 5600-7 (1994); Kayushin A et al., *Nucleic Acids Res* 24: 3748-55 (1996); Zhao H, Arnold F, *Nucleic Acids Res* 25:1307-8 (1997); Harayama S, *Trends Biotechnol* 16: 76-82 (1998); Zhao H et al., *Nat Biotechnol* 16: 258-261 (1998); Horst J et al., *Trends Microbiol* 7:29-36 (1999); Cola G et al., *J Immunol Methods* 251: 187-93 (2001); Collins J et al., *J Biotechnol* 74: 317-38 (2001); Hayes R et al., *Proc Natl Acad Sci USA* 99: 15926-31 (2002); Wang L et al., *Proc Natl Acad Sci USA* 101: 16745-9 (2004); Mena M, Daugherty P, *Protein Eng Des Sel* 18: 559-61 (2005); Bratkovic T, *Cell Mol Life Sci* 67: 749-67 (2010); Labrou N et al., *Curr Protein Pept Sci* 11: 91-100 (2010); Mandrup O et al., *PLoS One* 8: e76834 (2013)). Mutagenesis and combinatorial assembly may be combined using selected subregions, cassettes, and/or modules, such as, e.g., specific immunoglobulin CDR regions (see e.g. Chen W et al., *Mol Immunol* 47: 912-21 (2010)). Mutagenesis techniques and/or recombination techniques can be used to mimic the V(D)J recombination process which occurs naturally during immune responses in mammals (King D et al., *Curr Drug Discov Technol* 11: 56-64 (2014)). Diversity may be introduced both before the first selection step as well as after library enrichment for improvement of selected-for properties from among a biased group.

Protein display screening may involve selection and/or enrichment steps based on numerous selected-for characteristics (see Glöckler J et al., *Molecules* 15: 2478-90 (2010); Boersma Y, Plückthun A, *Curr Opin Biotechnol* 22: 849-57 (2011); Bradbury A et al., *Nature Biotech* 29: 245-54 (2011)). Commonly, molecular interactions are screened for by using a binding assay, such as, e.g., self-interaction nanoparticle spectroscopy (SINS), affinity chromatography, immobilized surface bound target, enzyme-linked immunosorbent assay, surface plasmon resonance binding (e.g. BIAcore), and flow cytometry (see e.g. Leonard P et al., *J Immunol Methods* 323: 172-9 (2007); Mazor Y et al., *J Immunol Methods* 321: 41-59 (2007); Jeong K et al., *Proc Natl Acad Sci USA* 104: 8247-52 (2007); Bengali A, Tessier P et al., *Biotechnol Bioeng* 104: 240-50 (2009); Turunen L et al., *J Biomol Screen* 14: 282-93 (2009); Yabe T et al., *J Biol Chem* 286: 12397-406 (2011); Diamante L et al., *Protein Eng Des Sel* 26: 713-24 (2013); Habib I et al., *Anal Biochem* 438: 82-9 (2013); Salema V et al., *PLoS One* 8: e75126 (2013); Wu Y et al., *Int J Mol Med* 32: 1451-7 (2013); Houlihan G et al., *J Immunol Methods* 405: 47-56 (2014)). Selections may be performed using purified targets or against whole cells displaying hundreds of potential antigens simultaneously. For example, tumor-associated antigen binding proteins may be selected for using protein display library screening of whole cells expressing the antigens of interest (see e.g. Pavoni E et al., *Mol Immunol* 57: 317-22 (2014)).

The number of rounds of selections performed often depends on the diversity of the library being screened, the affinity of any positive hits, the stringency of the selection, and the presence of any amplification biases. Negative selection steps may be used to deplete non-specific or unselective binders, including using polyspecific reagents (see Siva A et al., *J Immunol Methods* 330: 109-19 (2008); Xu Y et al., *Protein Eng Des Sel* 26: 663-70 (2013)). Nucleic acid sequencing steps can improve efficiency of screening large libraries, such as, e.g. by ribosome display (see e.g. Larman H et al., *Proc Natl Acad Sci USA* 109: 18523-8 (2012); 't Hoen P et al., *Anal Biochem* 421: 622-31 (2012); Larman H et al., *Nat Protoc* 9: 90-103 (2014)).

Although the majority of examples involve immunoglobulin derived binding domains, other polypeptide-based binding domains, also seen as alternatives to immunoglobulins, have been successfully screened for specific molecular interactions using the same or similar methods (see e.g. Binz H et al., *Nat Biotechnol* 23: 1257-1268 (2005); Binz H, Plückthun A, *Curr Opin Biotechnol* 16: 459-69 (2005); Chao G et al., *Nat Protoc* 1: 755-68 (2006); Paschke M, *Appl Microbiol Biotechnol* 70: 2-11 (2006); Zahnd C et al., *Nat Methods* 4: 269-79 (2007); Skerra A, *Curr Opin Biotechnol* 18: 295-304 (2007)). For examples of screening and identification of non-immunoglobulin derived, immunoglobulin-type binding regions, see Xu L et al., *Chem Biol* 9: 933-42 (2002); Hackel B et al., *J Mol Biol* 381: 1238-52 (2008); Skerra A, *FEBS J* 275: 2677-83 (2008); Saerens D et al., *J Immunol Methods* 329: 138-50 (2008); Bloom L, Calabro V, *Drug Discov Today* 14: 949-55 (2009); Gebauer M, Skerra A, *Curr Opin Chem Biol* 13: 245-55 (2009); Liao H et al., *J Biol Chem* 284: 17512-20 (2009); Lloyd C et al., *Protein Eng Des Sel* 22: 159-68 (2009); Hackle B, Wittrup K, *Protein Eng Des Sel* 23: 211-9 (2010); Hackel B et al., *J Mol Biol* 401: 84-96 (2010); Lipovsek D, *Protein Eng Des Sel* 24 3-9 (2011); Tillib S et al., *Acta Nature* 2: 85-93 (2010); Wojcik J et al., *Nat Struct Mol Biol* 17: 519-27 (2010); Zahnd C et al., *Cancer Res* 70: 1595-605 (2010); Boersma Y, Plückthun A, *Curr Opin Biotechnol* 22: 849-57 (2011); Gebauer M, Skerra A, *Methods Enzymol* 503: 157-88 (2012); Jacobs S et al., *Protein Eng Des Sel* 25: 107-17 (2012); Koide S et al., *Methods Enzymol* 503: 135-56 (2012); Chen T et al., *Methods Enzymol* 523: 303-26 (2013)).

Characteristics besides binding affinity may be selected for such as, e.g., cellular internalization (see e.g. Becerril B et al., *Biochem Biphys Res Commun* 255: 386-93 (1999); Zhou Y et al., *J Mol Biol* 404: 88-99 (2010); Zou Y, Marks J, *Methods Enzymol* 502: 43-66 (2012); WO 2006/072773; US 2007/0298430).

After a binding region has been identified or enriched within a protein display library, the binding region may be improved in desired characteristics by further display library selections in process sometimes referred to as "maturation" (see e.g. Prabakaran P et al., *Front Microbiol* 3: 277 (2012); Renaut L et al., *Methods Mol Biol* 907: 451-61 (2012)). For example, eukaryotic cell display has proven very successful for affinity maturation (Boder E et al., *Proc Natl Acad Sci USA* 97: 10701-5 (2000); Pepper L et al., *Comb Chem High Throughput Screen* 11: 127-34 (2008)). In other examples, affinity maturation was accomplished in vitro using random mutagenesis of large immunoglobulin libraries (Hanes J et al., *Nat Biotechnol* 18: 1287-92 (2000); Kim H et al., *J Immunol Methods* 372: 146-61 (2011)). Affinity maturation has been performed on alternative scaffolds to immunoglobulins, such as, e.g., ankyrin repeat motif containing polypeptides (Zahnd C et al., *J Mol Biol* 369: 1015-28 (2007)). These methods have identified immunoglobulin binding regions with binding affinities higher than any observed for naturally occurring antibodies (Boder E et al., *Proc Natl Acad Sci USA* 97: 10701-5 (2000); Hanes J et al., *Nat Biotechnol* 18: 1287-1292 (2000); Lee C et al., *J Mol Biol* 340: 1073-93 (2004); Razai A et al., *J Mol Biol* 351: 158-69 (2005); Geyer C et al., *Methods Mol Biol* 901: 11-32 (2012)). However, phage display of synthetic combinatorial immunoglobulin libraries was used to find high-affinity human antibodies without the need for time-consuming affinity maturation steps (Hoet R et al., *Nat Biotechnol* 23:

344-8 (2005)). In addition, display library screening may be used to evolve the binding specificity of a binding region away from a high-affinity target and toward a homologous target based on the existence of pre-existing weak binding (Bostrom J et al., *Science* 323: 1610-4 (2009).

Specific methods exist for generating display screening libraries derived from human immunoglobulins (Casali P et al., *Science* 234: 476-9 (1986); Weitkamp J et al., *J Immunol Methods* 275; 223-37 (2003); Tiller T et al., *J. Immunol Methods* 329: 112-24 (2008); Scheid J et al., *J Immunol Methods* 343: 65-7 (2009); Scheid J et al., *Nature* 458: 636-40 (2009); Di Niro R et al., *J Immunol* 185: 5377-83 (2010); Di Niro R et al., *Nature Med* 18: 441-5 (2012)). For example, immunoglobulin display libraries may be generated from human bone marrow, peripheral blood, and splenic human B cells (Marasco W, Sui J, *Nature Biotech* 25: 1421-34 (2007)). Human immune cells may be cell sorted using flow cytometry to choose among total peripheral blood mononuclear cell populations, memory B-cells, plasmablasts, plasma cells, activated B-cells, and/or naïve B-cells. Then, nucleic acids are cloned from these samples in order to construct immunoglobulin libraries for screening. B-cells which express immunoglobulins on their surface may be pre-sorted for binding to a target before constructing immunoglobulin libraries for screening, such as by using single cell expression cloning (Lanzavecchia A et al., *Curr Opin Biotechnol* 18: 523-8 (2007)). Commonly, the heavy and light chain regions are cloned separately and recombined when constructing a library for screening. The shuffling of heavy and light chain regions can provide for an increased diversity of immunoglobulin binding space to explore and identify high affinity binders (Marks J et al., *Biotechnology* 10: 779-83 (1992)).

Selection steps include in vivo phage display to identify tissue specific targeting after systemic administration (Bábíčková J et al., *Biotechnol Adv* 31: 1247-59 (2013)). Monoclonal human antibodies may be identified by combining immunization with mammalian cell display and in vitro somatic hypermutation (McConnell A et al., *PLoS ONE* 7: e49458 (2012).

Protein display technologies enable the rapid isolation of biological sequences with desired properties. All protein display technologies utilize the ability to display library members on suitable carriers that couple the phenotype of the displayed protein to a genotype linked to the carrier. Typically, protein display is used to optimize binding affinity and binding specificity (Levin A, Weiss G, *Mol Biosyst* 2: 49-57 (2006)). Various protein display screening methods exist, such as bacteriophage display (Sidhu S, Koide S, *Curr Opin Struct Biol* 17: 481-7 (2007)), cell-surface display (prokaryotic or eukaryotic) (Chao G et al., *Nat Protoc* 1: 755-68 (2006); Wu et al., *Trends Microbiol* 16: 181-8 (2008); Löfblom J, *Biotechnol J* 6: 1115-29 (2011); Gera N et al., *Methods* 60: 15-26 (2013)), RNA display, protein-DNA linkage display (Odegrip R et al., *Proc Natl Acad Sci USA* 101: 2806-10 (2004); Reiersen H et al., *Nucleic Acid Res* 33: e10 (2005)), bead surface display (Diamante L et al., *Protein Eng Des Sel* 26: 713-24 (2013)), ribosome display (Plückthun A, *Methods Mol Biol* 805: 3-28 (2012)), and virus display (Jermutus L et al., *Eur Biophys J* 31: 179-84 (2002); Sepp A et al., *FEBS Lett* 532, 455-9 (2002); US 2003/0186,374; Swers J et al., *Nucleic Acid Res* 32: e36 (2004); Urban J et al., *Nucleic Acids Res* 33: e35 (2005); Granieri L et al., *Chem Biol* 17: 229-35 (2010)). Some non-limiting examples of protein display are discussed further below.

1. In Vitro Protein Display Platforms

An in vitro protein display platform is one in which screening, selection, and/or enrichment steps may be performed without a living system. While phage display is probably the most successful and routinely used in vitro protein display platform, the later development of completely cell-free in vitro protein display systems like RNA display, ribosome display, and protein-DNA linkage systems enabled widespread screening of even larger libraries (e.g. $1 \times 10^{15}$ unique library members). An advantage of fully in vitro display methods, like RNA and ribosome display, is the obviation of any in vivo cloning steps, which are typically limited by the maximum efficiencies of transformation, transfection, and the like.

a. Phage Display Screening

Phage display screening is an in vitro method which has been widely used with great success (Geyer C et al., *Methods Mol Biol* 901: 11-32 (2012); Zou Y, Marks J, *Methods Enzymol* 502: 43-66 (2012)). Routine phage display libraries have complexities typically in the range of $1 \times 10^6$ to $1 \times 10^{10}$ and have been used to develop numerous FDA approved biologics (Thie H et al., *Curr Pharm Biotechnol* 9: 439-46 (2008); Bratkovic T, *Cell Mol Life Sci* 67: 749-67 (2010)). Commonly, a filamentous phage species like M13 is used to display a polypeptide fused via a linker to one of its major coat proteins like pII and pVIII. Phage display screening is effective for screening and identifying immunoglobulin derived polypeptides and non-immunoglobulin polypeptides with desired characteristics, such as, e.g., high affinity binding to cancer antigens and infectious disease antigens (see e.g. Vaughan T et al., *Nat Biotechnol* 14: 309-14 (1996); Silverman J et al., *Nat Biotechnol* 23: 1556-61 (2005); Steiner D et al., *J Mol Biol* 382: 1211-27 (2008); Kim H et al., *J Am Chem Soc* 131: 3565-76 (2009); Huang Y et al., *J Biol Chem* 285: 7880-91 (2010); Tillib S et al., *Acta Naturae* 2: 85-93 (2010); Geyer C et al., *Methods Mol Biol* 901: 11-32 (2012); Ohtani M et al., *Fish Shellfish Immunol* 34: 274-8 (2013); Zhang J et al., *FASEB J* 27: 581-9 (2013)). In addition, complex binding regions, such as e.g., disulfide stabilized scFvs may be screened and identified using phage display (Chen I et al., *Mol Biosyst* 6: 1307-15 (2010)). Phage display may be used to identify binders of intracellular targets even under reducing conditions, such as, e.g., intrabodies (Cardinale A, Biocca S, *Trends Mol Med* 14: 373-80 (2008); Marschall A et al., *MAbs* 3: 3-16 (2011); Ramgel R et al., *Nat Protoc* 8: 1916-39 (2013); Kaiser P et al., *Biochim Biophys Acta* 1844: 1933-42 (2014)).

For example, a phagemid display library may be constructed using random fusions of $V_H$ and $V_L$ domains or co-expression of $V_H$ and $V_L$ polypeptides which bind to form Fabs. Phagemid display libraries may be screened for phage displaying an immunoglobulin-type polypeptide which binds with high affinity to a target by a biopanning and/or iterative biopanning using binding affinity assays, such as, e.g., immobilized targets on ELISA plates, on cell surfaces, or on microbeads. Then after the steps of washing, isolation, and/or bound phage elution, recovered phage are clonally reamplified in *E. coli* hosts. During each round, specific binders are selected for by washing away non-binders and selectively eluting binding phage clones. After three or four rounds, phage clones with highly specific binding to the target may be identified.

b. Ribosome Display Screening

Ribosome display screening for high-affinity binding regions has been performed on both immunoglobulin derived polypeptides and non-immunoglobulin polypeptides (see e.g. Hanes J, Plückthun A, *Proc Natl Acad Sci USA* 94: 4937-42 (1997); Hanes J et al., *Proc Natl Acad Sci USA* 95:

14130-5 (1998); Hanes J et al., *FEBS Lett* 450: 105-10 (1999); Schaffitzel C et al., *J Immunol Methods* 231: 119-35 (1999); Hanes J et al., *Nat Biotechnol* 18: 1287-92 (2000); Sun Y et al., *PLoS One* 7: e33186 (2012); Liu J et al., *Analyst* 137: 2470-9 (2012); Seeger M et al., *Protein Sci* 22: 1239-57 (2013); U.S. Pat. Nos. 6,620,587; 7,074,557; US 2006/0177862; WO 2001/075097). For example, immunoglobulin derived binding regions which bind the cell surface target PVRL4 were identified using ribosome display coupled with deep-sequencing (Larman H et al., *Nat Protoc* 9: 90-103 (2014)). Other examples, show ribosome display has been used extensively for selection of molecules from immunoglobulin alternative polypeptide scaffold libraries (see e.g. Zahnd C et al., *J Mol Biol* 369: 1015-28 (2007); *Ribosome Display and Related Technologies—Methods and Protocols*, Methods in Molecular Biology, vol. 805: pp. 261-334 (Eds. Douthwaite J, Jackson R. Humana Press 2012).

For example, ribosome display approaches often require non-covalent ternary polypeptide-ribosome-RNA complexes to couple genotypes and phenotypes. The lack of any stop codons in the RNA prevents the release of the RNA (genotype) and the polypeptide from the ribosome. These ribosome ternary complexes are formed during in vitro translation. High concentrations of magnesium and low temperature may be used to further stabilize these ternary complexes. Screening and selection steps may be performed directly on these ternary complexes to identify displayed polypeptides with specific characteristics, including binding affinity in an intracellular environment, see US 2011/0008774.

Ribosome display may be used for selecting high-affinity binding regions within phage display libraries which have already been enriched for binding to a target by using increasingly more stringent selection steps with decreasing target concentrations (*Ribosome Display and Related Technologies—Methods and Protocols*, Methods in Molecular Biology, vol. 805: pp. 161-190 (Eds. Douthwaite J, Jackson R. Humana Press 2012)). In addition, ribosome display may be used to select for improved polypeptide stability, such as by challenging stability with dithiothreitol or high temperature during a selection step which can discriminate the stability of the polypeptide (*Ribosome Display and Related Technologies—Methods and Protocols*, Methods in Molecular Biology, vol. 805: pp. 191-212 (Eds. Douthwaite J, Jackson R. Humana Press 2012).

A specialized type of ribosome display is intracellular ribosome display, which enables the optimization of bacterial production characteristics of polypeptides such as, e.g., scFvs (see e.g. Contreras-Martínez L, DeLisa M, *J Mol Biol* 372: 513-24 (2007); Kaiser P et al., *Biochim Biophys Acta* 1844: 1933-42 (2014)).

c. RNA Display Screening

RNA display screening for high-affinity binding regions has been performed on both immunoglobulin derived polypeptides and non-immunoglobulin polypeptides (Roberts R, Szostak J, *Proc Natl Acad Sci USA* 94: 12297-302 (1997); Nemoto N et al., *FEBS Lett* 414: 405-8 (1997); Liu R et al., *Methods Enzymol* 318: 268-293 (2000); Getmanova et al., *Chem Biol* 13: 549-56 (2006); Liao H et al., *J Biol Chem* 284: 17512-20 (2009); Emanuel S et al., *MAbs* 3: 38-48 (2011); *Ribosome Display and Related Technologies—Methods and Protocols*, Methods in Molecular Biology, vol. 805: pp. 87-100 (Eds. Douthwaite J, Jackson R. Humana Press 2012; U.S. Pat. Nos. 6,214,553; 6,249,300; 6,258,558; 6,261,804; 6,281,344; 6,623,926; 6,518,018; 6,602,685; 7,270,950; 7,790,421; WO 2010/039850; WO 2011/049157; US 2010/0105569; US 2014/0128275). For example, fibronectin-derived $10^{th}$ fibronectin type I domain RNA display libraries were screened for interactions with TNF, and scFv RNA display libraries were screened for interactions with fluorescein (Xu L et al., *Chem Biol* 9: 933-42 (2002); Fukuda I et al., *Nucleic Acids Res* 34: e127 (2006)).

d. DNA Display: Protein-DNA Linkage Display Screening

In DNA linkage display (also referred to as DNA display), DNA fragments encoding randomized polypeptide sequences are complexed to the polypeptides which they encode after in vitro transcription and translation via covalent or non-covalent bonds (Odegrip R et al., *Proc Natl Acad Sci USA* 101: 2806-10 (2004); Doi N et al., *J Biotechnol* 131: 231-9 (2007); U.S. Pat. No. 6,416,950). A specific type of DNA linkage display involves the use of microbead affinity interactions to link the display polypeptide to a DNA molecule encoding it via a microbead (Diamante L et al., *Protein Eng Des Sel* 26: 713-24 (2013)).

2. Cell Surface Display Platforms

In some systems, the display of the protein or polypeptide is based on using a transmembrane domain to tether the library members to the outer surface of a cell. Cell-based protein display platforms enable, during screening, the use of flow cytometry cell sorting, such as, e.g., by fluorescence activation, magnetism, or binding affinity. Both prokaryotes and eukaryotes may be used for cell-based protein display screening. An advantage of using eukaryotic cells for cell surface display is the presence of a eukaryotic protein folding environment and post-translation modifications, such as, e.g., oxidative environment and N-linked glycosylation.

a. Prokaryotic Cell Surface Display Screening

Bacterial display screening has been used to identify immunoglobulin type binding regions specific for target proteins (Löfblom J, *Biotechnol J* 6: 1115-29 (2011)). Various bacterial species may be used such as, e.g., gram-negative bacteria like *Escherichia* and gram-positive bacteria like *Bacillus* and *Staphylococcus* (see Fleetwood F et al., *Cell Mol Life Sci* 70: 1081-93 (2013)). Flow cytometry methods may be performed when screening bacterial display libraries (see e.g. Zhang S, Link A, *Integr Biol* (Camb) 3: 823-31 (2011)). In addition, proteins may be displayed on bacterial spores (see e.g. Kim J, Schumann W, *Cell Mol Life Sci* 66: 3127-36 (2009)). Bacteria may be used to screen for binders of intracellular targets, such as, e.g., intrabodies (see e.g. Fisher A, DeLisa M, *J Mol Biol* 385: 299-311 (2009); Kaiser P et al., *Biochim Biophys Acta* 1844: 1933-42 (2014)).

b. Eukaryotic Cell Surface Display Screening

Unicellular eukaryotic cells may be used for cell surface display. For example, yeast surface display screening has been used to improve characteristics regarding affinity, specificity, expression, stability, and catalytic activity (Gai S, Wittrup K, *Curr Opin Struct Biol* 17: 467-73 (2007)).

Yeast surface display utilizes recombinant fusion proteins designed from yeast surface proteins, such as glycosylated phosphatidylinositol (GPI) anchored proteins like α-agglutinin (Aga2p), flocculin, Cwp1p, Cwp2p, and Tip1p, and Pir family proteins like Pir1-4 (Kondo A, Ueda M, *Appl Microbiol Biotechnol* 64: 28-40 (2004); Khasa Y et al., *Yeast* 28: 213-26 (2011)). Various species of yeast may be used including *S. cerevisiae*, *S. pombe*, and methylotrophic strains such as *P. pastoris* and *H. polymorpha*. Yeast surface display allows for the display of multimeric proteins including multichain proteins assembled using disulfide bridges such as, e.g., immunoglobulins (Lin Y et al., *Appl Microbiol Biotechnol* 62: 226-32 (2003); van den Beucken T et al., *FEBS Lett* 546: 288-94 (2003)).

Yeast surface display screening has been used to selected high-affinity immunoglobulin derived binding regions (see e.g. Feldhaus M et al., *Nat Biotechnol* 21: 163-70 (2003); Walker L et al., *J Mol Biol* 389: 365-75 (2009); U.S. Pat. No. 8,372,636). Yeast surface display has been highly successful for affinity maturation (see e.g. Wang Z et al., *Bioconjug Chem* 18: 947-55 (2007); Pepper L et al., *Comb Chem High Throughout Screen* 11: 127-34 (2008)). Yeast surface display has an advantage for displaying polypeptides and proteins related to cell surface because the displayed polypeptides and protein can take on conformations in the context of a eukaryotic cell membrane surface (Tillotson B et al., *Methods* 60: 27-37 (2013)).

Yeast display may be combined with phage display to produce a powerful combination screening method to identify immunoglobulin-type binding regions (Ferrara F et al., *PLoS One* 7: e49535 (2012)). Yeast display may be combined with RNA display to produce a powerful combination screening method to identify immunoglobulin-type binding regions, see, e.g., WO 2012/158739.

Eukaryotic cells derived from multicellular organisms may be used for eukaryotic cell surface display screening. In particular, mammalian cell surface display screening has become widely applied (Bowers P et al., *Methods* 65: 44-56 (2014)). Mammalian surface cell display screening offers the advantages of more optimal polypeptide folding and post-translational modifications to select polypeptides appropriate for developing drugs for administration to mammals, such as, e.g., a human subject (see Vendel M et al., *Arch Biochem Biophys* 526: 188-93 (2012)). For example, mammalian cell display has been used to identify human antibodies with desired binding specificity (Bowers P et al., *Proc Natl Acad Sci USA* 108: 20455-60 (2011); McConnell A et al., *PLoS One* 7: e49458 (2012)). In addition, full-length, multi-chain immunoglobulins may be displayed on mammalian cells using stable or transient expression systems such as, e.g., Flp recombinase, non-replicating plasmids, episomally replicating plasmids, Sindbis viral vectors, and vaccine viral vectors (Akamatsu Y et al., *J Immunol Methods* 327: 40-52 (2007); Beerli R et al., *Proc Natl Acad Sci USA* 105: 14336-41 (2008)); Ho M, Pastan I, *Methods Mol Biol* 562: 99-113 (2009); Zhou C et al., *mAbs* 2: 508-18 (2010); Bowers P et al., *Proc Natl Acad Sci USA* 108: 20455-60 (2011); Li C et al., *Cell Mol Immunol* 9: 184-190 (2012)). For example, mammalian cell display may be performed using retroviral vectors (Breous-Nystrom E et al., *Methods* 65: 57-67 (2014)). A human cell display system with a secretion feature has been used for human immunoglobulin binding region screening (Horlick R et al., *J Biol Chem* 288: 19861-9 (2013)). Mammalian cell surface display has been used for binding region affinity maturation (Bowers P et al., *Methods* 65: 44-56 (2014)). Eukaryotic cells may be used to screen for binders of intracellular targets, such as, e.g., intrabodies (see e.g. Gennari F et al., *J Mol Biol* 335: 193-207 (2004); Mazuc E et al., *PLoS One* 9: e104998 (2014); Kaiser P et al., *Biochim Biophys Acta* 1844: 1933-42 (2014)).

V. Variations in the Polypeptide Sequence of the Cytotoxic Polypeptides Created as a Result of Display Screening Using a Method of the Invention The skilled worker will recognize that variations may be made to the exemplary non-ribotoxic and/or reduced-ribotoxicity templates of the ribotoxic region polypeptides provided herein. Similarly, the skilled worker will recognize that numerous variations are possible when designing non-ribotoxic and/or reduced-ribotoxicity templates of ribotoxic regions for use in the present invention. In addition, the skilled worker will recognize that variations may be made to the polynucleotides encoding any of the former. For example, some modifications may facilitate expression, purification, and/or pharmacokinetic properties, and/or immunogenicity. Such modifications are well known to the skilled worker and include, for example, a methionine added at the amino terminus to provide an initiation site, additional amino acids placed on either terminus to create conveniently located restriction sites or termination codons, and biochemical affinity tags fused to either terminus to provide for convenient detection and/or purification.

The skilled worker will recognize that variations may be made to any cytotoxic polypeptide of the invention identified using a method of the present invention. In addition, the skilled worker will recognize that variations may be made to the cytotoxic polypeptides of the invention, without diminishing their biological activities, e.g., by maintaining the overall structure and function of the ribotoxic region and the binding region.

Also contemplated herein is the inclusion of additional amino acid residues at the amino and/or carboxy termini, such as sequences for epitope tags or other moieties. The additional amino acid residues may be used for various purposes including, e.g., facilitating cloning, facilitating expression, post-translational modification, facilitating synthesis, purification, facilitating detection, and administration. Non-limiting examples of epitope tags and moieties are chitin binding protein domains, enteropeptidase cleavage sites, Factor Xa cleavage sites, FIAsH tags, FLAG tags, green fluorescent proteins (GFP), glutathione-S-transferase moieties, HA tags, maltose binding protein domains, myc tags, polyhistidine tags, ReAsH tags, strep-tags, strep-tag II, TEV protease sites, thioredoxin domains, thrombin cleavage site, and V5 epitope tags.

In certain of the above embodiments, the polypeptide sequence of the cytotoxic polypeptides of the present invention are varied by one or more conservative amino acid substitutions introduced into the polypeptide region(s). As used herein, the term "conservative substitution" denotes that one or more amino acids are replaced by another, biologically similar amino acid residue. Examples include substitution of amino acid residues with similar characteristics, e.g. small amino acids, acidic amino acids, polar amino acids, basic amino acids, hydrophobic amino acids and aromatic amino acids (see e.g. Table C). An example of a conservative substitution with a residue normally not found in endogenous, mammalian peptides and proteins is the conservative substitution of an arginine or lysine residue with, for example, ornithine, canavanine, aminoethylcysteine, or another basic amino acid. For further information concerning phenotypically silent substitutions in peptides and proteins see, e.g., Bowie J et al., *Science* 247: 1306-10 (1990).

TABLE C

Examples of Conservative Amino Acid Substitutions

| I | II | III | IV | V | VI | VII | VIII | IX | X | XI | XII | XIII | XIV |
|---|---|---|---|---|---|---|---|---|---|---|---|---|---|
| A | D | H | C | F | N | A | C | F | A | C | A | A | D |
| G | E | K | I | W | Q | G | M | H | C | D | C | C | E |
| P | Q | R | L | Y | S | I | P | W | F | E | D | D | G |
| S | N | | M | | T | L | | Y | G | H | G | E | K |
| T | | | V | | | V | | | H | K | N | G | P |
| | | | | | | | | | I | N | P | H | Q |
| | | | | | | | | | L | Q | S | K | R |
| | | | | | | | | | M | R | T | N | S |

TABLE C-continued

Examples of Conservative Amino Acid Substitutions

| I | II | III | IV | V | VI | VII | VIII | IX | X | XI | XII | XIII | XIV |
|---|----|-----|----|----|----|-----|------|----|----|----|-----|------|-----|
|   |    |     |    |    |    |     |      |    | R  | S  | V   | Q    | T   |
|   |    |     |    |    |    |     |      |    | T  | T  |     | R    |     |
|   |    |     |    |    |    |     |      |    | V  |    |     | S    |     |
|   |    |     |    |    |    |     |      |    | W  |    |     | P    |     |
|   |    |     |    |    |    |     |      |    | Y  |    |     | T    |     |

In the conservative substitution scheme in Table C, exemplary conservative substitutions of amino acids are grouped by physicochemical properties—I: neutral, hydrophilic; II: acids and amides; III: basic; IV: hydrophobic; V: aromatic, bulky amino acids, VI hydrophilic uncharged, VII aliphatic uncharged, VIII non-polar uncharged, IX cycloalkenyl-associated, X hydrophobic, XI polar, XII small, XIII turn-permitting, and XIV flexible. For example, conservative amino acid substitutions include the following: 1) S may be substituted for C; 2) M or L may be substituted for F; 3) Y may be substituted for M; 4) Q or E may be substituted for K; 5) N or Q may be substituted for H; and 6) H may be substituted for N.

Additional conservative amino acid substitutions include the following: 1) S may be substituted for C; 2) M or L may be substituted for F; 3) Y may be substituted for M; 4) Q or E may be substituted for K; 5) N or Q may be substituted for H; and 6) H may be substituted for N.

In certain embodiments, the cytotoxic polypeptides of the present invention may comprise functional fragments or variants of a polypeptide region of the invention that have, at most, 20, 15, 10, 9, 8, 7, 6, 5, 4, 3, 2, or 1 amino acid substitutions compared to a polypeptide sequence recited herein as long as the polypeptides retain the functionality of that region (e.g. binding function(s) for binding regions and ribotoxicity for ribotoxic regions). Variants of the cytotoxic polypeptides of the invention are within the scope of the invention as a result of changing a polypeptide of the invention by altering one or more amino acids or deleting or inserting one or more amino acids, such as within the binding region or the ribotoxic region, in order to achieve desired properties, such as changed cytotoxicity, changed cytostatic effects, changed immunogenicity, and/or changed serum half-life.

Accordingly, in certain embodiments, the ribotoxic region of the cytotoxic polypeptides of the present invention comprise or consists essentially of amino acid sequences having at least 55%, 60%, 65%, 70%, 75%, 80%, 85%, 90%, 95%, 97%, 98%, 99%, 99.5% or 99.7% overall sequence identity to a naturally occurring toxin, such as, e.g., one of any sequence recited in SEQ ID NOs: 1-14.

In certain embodiments of the cell-targeted molecules of the present invention, one or more amino acid residues may be mutated, inserted, or deleted in order to increase the enzymatic activity of the ribotoxic region of a cytotoxic polypeptide of the invention. For example, mutating residue-position alanine-231 in Stx1A to glutamate increased its enzymatic activity in vitro (Suhan M, Hovde C, *Infect Immun* 66: 5252-9 (1998)), and mutating the arginine-490 in PE to alanine, glycine, isoleucine, valine, or leucine increased its enzymatic activity (WO 2005052006).

VI. Nucleic Acids, Libraries, and Identified Ribotoxic Proteins and Polypeptides Beyond the screening methods of the present invention, the present invention encompasses the nucleic acids, libraries of nucleic acids, library encoded polypeptides, and display polypeptide libraries created by any method of the present invention. In addition, the present invention encompasses any polynucleotide identified using a method of the present invention.

For examples of nucleic acids, nucleic acids and libraries of nucleic acids which encode one or more polypeptides comprising a modified ribotoxic region with reduced or eliminated ribotoxicity created by a method of the present invention are within the scope of the present invention. This includes expression libraries encoding fusion polypeptides comprising a modified ribotoxic region with reduced or eliminated ribotoxicity. This also includes nucleic acids and libraries comprising nucleic acid templates which encode one or more modified ribotoxic region polypeptides are within the scope of the present invention. Any nucleic acid identified using a screening method of the present invention which encodes a fusion polypeptide comprising a ribotoxic region with reduced or eliminated ribotoxicity is within the scope of the present invention. Any nucleic acid which encodes a fusion polypeptide comprising a ribotoxic region with reduced or eliminated ribotoxicity identified using a screening method of the present invention is within the scope of the present invention as well as any ribotoxic forms thereof revealed by the nucleic acid sequence.

In addition, any nucleic acid identified using a screening method of the present invention is within the scope of the present invention whether based on a modified ribotoxic region or unmodified ribotoxic region. This includes any nucleic acid library resulting from the screening, positive selection, negative selection, and/or enrichment for one or more characteristics using a screening method of the invention.

For examples of polypeptides, the libraries of displayed polypeptides comprising a modified ribotoxic region with reduced or eliminated ribotoxicity are within the scope of the present invention. Any polypeptide identified using a screening method of the present invention is within the scope of the present invention whether based on a modified ribotoxic region or unmodified ribotoxic region. This includes any polypeptide library resulting from the screening, positive selection, negative selection, and/or enrichment for one or more characteristics using a screening method of the invention.

In creating libraries of nucleic acid for expression, any suitable expression vector may be used. For example, prokaryotic cloning vectors include plasmids from *E. coli* such as, e.g., colE1, pCR1, pBR322, pMB9, pUC, pKSM, and RP4. Prokaryotic vectors also include derivatives of phage DNA such as, e.g., M13 and other filamentous single-stranded DNA phages. An example of vectors useful in yeast are the 2μ plasmid, p YD1, pCTCON2, pDNL6, pPNL6, pNLS, pPIC, and pGAPZ. Suitable vectors for expression in mammalian cells include well-known derivatives of SV40, adenovirus, retrovirus, other viral-derived DNA sequences, pDisplay™, and shuttle vectors derived from combination of functional mammalian vectors, such as those described above, and functional plasmids and phage DNA.

A. Diverse Libraries for In Vitro Display Approaches

In certain embodiments of the libraries of the present invention are nucleic acid libraries comprising a plurality of polynucleotides capable of encoding a plurality of binding regions, each fused to a modified ribotoxic region comprising at least one amino acid mutation such that ribotoxicity is reduced or eliminated.

In certain embodiments of the libraries of the present invention are nucleic acid expression libraries comprising a plurality of polynucleotides capable of encoding a plurality of binding regions, each fused to a modified ribotoxic region comprising at least one amino acid mutation such that ribotoxicity is reduced or eliminated and each in an operable combination capable of expression by C. Constructing Expression Libraries for Display Screening An expression library may be constructed by joining a plurality of polynucleotides, each encoding a fusion polypeptide, in an operable combination with an expression vector.

The term "operable combination" refers to the manner of linking or joining coding sequences such that the desired function, such as expression or display, is achieved. Methods of achieving operable combination are well known in the art and include such well known practices as placing the sequences in-frame for effective expression or placing sequences within effective spatial distances to take advantage of sequence function (i.e., that of a promoter or enhancer during expression).

The term "expression library of diverse nucleic acids" refers to the collection of polynucleotides capable of encoding a plurality of fusion polypeptides comprising binding regions and modified ribotoxic regions. By joining this library in operable combination with sequences needed for effective expression and display, the "expression library of diverse members" may be constructed and utilized to express a plurality of fusion polypeptides, wherein each fusion polypeptide comprises said binding region and said ribotoxic region.

A possible first step of the method is constructing a nucleic acid library of a plurality of polynucleotides encoding fusion polypeptides. The first step of this construction is providing a plurality of polynucleotides that encode different binding regions (see e.g. WO 2008/067547). This step can be achieved using many methods well known in the art, such as the isolation of naive binding regions from a non-immunized organism (see, e.g., Zhu Z, Dimitrov D, *Methods Mol Biol* 525:129-42 (2009) or through synthetic library construction (see, e.g., Griffiths et al., *EMBO J* 13: 3245-60 (1994); Mondon P et al., *Front Biosci* 13: 1117-29 (2008); Prassler J et al., *J Mol Biol* 413: 261-78 (2011)).

For example, organisms can be immunized with a target molecule or nucleic acid encoding the target molecule, a tumor cell, or an intracellular pathogen in order to generate immune cells in the organism for isolation of nucleic acids enriched for immunoglobulin domains which specifically target the immunization material (see, e.g. Popkov M, Berry J, *Phage Display in Biotechnology and Drug Discovery*. Ch. 15: pp. 529-657 (CRC Press 2005)). Any chordate with an adaptive immune system can be used in this method, but efficiencies can be gained by utilizing humans, human cells, or organisms comprising transgenic human immune systems when producing a cytotoxic polypeptide for administration to humans. Some chordates contemplated for immunization include humans, mice, rabbits, guinea pigs, camels, llama, sheep, goat, and birds. If human-based immune systems or cells are not used, it is contemplated that the resulting binding region may optionally be optimized during the development process using humanization, a well-known procedure (Almagro J, Fransson J, *Frontiers in Biosci* 1: 1619-33 (2008)).

It is not necessary to know beforehand the exact target molecule being sought, however, as long as the source of the molecule, i.e. the cancer cell type that is to be killed, is known (Shen et al., *Cell Research* 17: 650-60 (2007)). As is well known in the art, by using cross-selection processes, it is possible to isolate binding regions that target molecules that are specific to the cell type sought to be killed, but which are relatively rare on cell types that are to be spared. This process helps to reduce unwanted side effects due to the unintended death of noncancerous cells within the subject being treated (see, Dantas-Barbosa C et al., *Int J of Mol Sci* 12: 5420-40 (2012), for a comprehensive review of the use of display libraries in oncology therapeutic development).

Protein display screening may be performed on libraries of polypeptides which comprise additional features such as, e.g., cyclic peptides and non-natural amino acids like β-cyclohexylalanine (Cha), β-(2-naphthyl)alanine (Nap), citrulline, gamma-carboxyglutamate, homocysteine (Hcy or Hey), hydroxyproline (Hyp), hydroxyprolinehypusine, N-formylmethionine, ornthinine (Om), penicillamine (Pen), p-acetylphenylalanine, p-azidophenylalanine (pAzF), p-benzophenylalanine, p-propargyloxyphenylalanine (pPaF), 4-chlorophenylalanine (PhCl), pyroglutamic acid, pyrrolysine (Pyl), selenocysteine (Scy or Sec), selenomethionine, thyroxine, and o-methyltyrosine which may be incorporated using various approaches such as, e.g., flexizyme, chemical synthesis of aminoacyl-tRNAs (see e.g. *Ribosome Display and Related Technologies—Methods and Protocols*, Methods in Molecular Biology, vol. 805: pp. 349-366 (Eds. Douthwaite J, Jackson R. Humana Press 2012); Albayrak C, Swartz J, *Nucleic Acids Res* 41: 5949-63 (2013); Passiora T, Suga H, *Chemistry* 19: 6530-6 (2013)), or post-translational modifications via a range of chemical strategies (Angelini A, Heinis C, *Curr Opin Chem Biol* 15: 355-61 (2011)).

The cytotoxic polypeptides of the libraries and/or identified by screening using the methods of the present invention may differ from a naturally occurring protein or polypeptide, such as, e.g., a toxin catalytic domain or other enzymatic domain such as an RNAse, by up to 1, 2, 3, 4, 5, 6, 7, 8, 9, 10, 15, 20, 25, 30, 35, 40 or more amino acid residues (but by no more than that which retains at least 85%, 90%, 95%, 99% or more amino acid sequence identity within an aligned region). Thus, a ribotoxic region derived from a naturally occurring protein may comprise additions, deletions, truncations, or other alterations from the original sequence so long as at least 85%, 90%, 95%, 99% or more amino acid sequence identity is maintained to a naturally occurring polypeptide region of the parental protein from which it was derived.

In particular, the invention provides variants of the cytotoxic fusion polypeptides of the invention, wherein the Shiga toxin ribotoxic region differs from a naturally occurring Shiga toxin A Subunit, such as, e.g., additions, deletions, truncations, or other alterations, by up to 1, 2, 3, 4, 5, 6, 7, 8, 9, 10, 15, 20, 25, 30, 35, 40 or more amino acid residues (but by no more than that which retains at least 85%, 90%, 95%, 99% or more amino acid sequence identity). Accordingly, in certain embodiments, the Shiga toxin ribotoxic region comprises or consists essentially of amino acid sequences having at least 55%, 60%, 65%, 70%, 75%, 80%, 85%, 90%, 95%, 97%, 98%, 99%, 99.5% or 99.7% overall sequence identity to a naturally occurring Shiga toxin A Subunit, such as SLT-1A (SEQ ID NO:1), StxA (SEQ ID NO:2), SLT-2A (SEQ ID NO:3), and/or Shiga toxin effector region polypeptide (SEQ ID NO:4).

In certain embodiments, the nucleic acids of the present invention encode a cytotoxic protein or polypeptide of the invention. In certain embodiments, the nucleic acids of the present invention encode a cytotoxic protein or polypeptide created or identified using any method of the present invention. In certain embodiments, the nucleic acids of the present invention are the nucleic acids produced by any method of the invention. In certain further embodiments, the nucleic acid comprises the polynucleotide sequence of any one of SEQ ID NOs: 40-64 or a derivative thereof. In certain embodiments, the molecular libraries of the present invention are the libraries produced by any method of the invention. In certain further embodiments, the molecular libraries comprise a nucleic acid comprising the polynucleotide sequence of any one of SEQ ID NOs: 40-64.

VII. Production of Cytotoxic Proteins and Polypeptides of the Present Invention

Any polypeptide identified using a screening method of the present invention is within the scope of the present invention whether based on a modified ribotoxic region or unmodified ribotoxic region. This includes any polypeptide library resulting from the screening, positive selection, negative selection, and/or enrichment for one or more characteristics using a screening method of the invention. In addition, this includes any polypeptide or protein derived from an identified polypeptide sequence, such as, e.g., a cytotoxic protein or polypeptide created using the sequence information identified using any method of the present invention.

Beyond the cytotoxic proteins and polypeptides of the present invention, the polynucleotides which encode such cytotoxic proteins or fusion polypeptides, or functional portions thereof, are within the scope of the present invention. The term "polynucleotide" is equivalent to the term "nucleic acids" both of which include polymers of deoxyribonucleic acids (DNAs), polymers of ribonucleic acids (RNAs), analogs of these DNAs or RNAs generated using nucleotide analogs, and derivatives, fragments and homologs thereof. The polynucleotide of the invention may be single-, double-, or triple-stranded. Disclosed polynucleotides are specifically disclosed to include all polynucleotides capable of encoding an exemplary cytotoxic fusion polypeptide, for example, taking into account the wobble known to be tolerated in the third position of RNA codons, yet encoding for the same amino acid as a different RNA codon (see Stothard P, *Biotechniques* 28: 1102-4 (2000)).

In one aspect, the invention provides polynucleotides which encode a cytotoxic fusion polypeptide of the invention, or a fragment or derivative thereof. The polynucleotides may include, e.g., a nucleic acid sequence encoding a polypeptide at least 50%, 55%, 60%, 65%, 70%, 75%, 80%, 85%, 90%, 95%, 99% or more, identical to a polypeptide comprising one of the amino acid sequences of the cytotoxic fusion polypeptide. The invention also includes polynucleotides comprising nucleotide sequences that hybridize under stringent conditions to a polynucleotide which encodes a cytotoxic fusion polypeptide of the invention, or a fragment or derivative thereof, or the antisense or complement of any such sequence.

Derivatives or analogs of the polynucleotides (or cytotoxic proteins or polypeptides) of the invention include, inter alia, polynucleotide (or polypeptide) molecules having regions that are substantially homologous to the polynucleotides or cytotoxic proteins and polypeptides of the invention, e.g. by at least about 45%, 50%, 70%, 80%, 95%, 98%, or even 99% identity (with a preferred identity of 80-99%) over a polynucleotide or polypeptide sequence of the same size or when compared to an aligned sequence in which the alignment is done by a computer homology program known in the art. An exemplary program is the GAP program (Wisconsin Sequence Analysis Package, Version 8 for UNIX, Genetics Computer Group, University Research Park, Madison, Wis., U.S.) using the default settings, which uses the algorithm of Smith T, Waterman M, *Adv. Appl. Math.* 2: 482-9 (1981). Also included are polynucleotides capable of hybridizing to the complement of a sequence encoding the proteins of the invention under stringent conditions (see e.g. Ausubel F et al., *Current Protocols in Molecular Biology* (John Wiley & Sons, New York, N.Y., U.S., 1993)), and below. Stringent conditions are known to those skilled in the art and may be found in *Current Protocols in Molecular Biology* (John Wiley & Sons, NY, U.S., Ch. Sec. 6.3.1-6.3.6 (1989)).

The present invention further provides expression vectors that comprise the polynucleotides within the scope of the invention. The polynucleotides capable of encoding the cytotoxic proteins and polypeptides of the invention may be inserted into known vectors, including bacterial plasmids, viral vectors and phage vectors, using material and methods well known in the art to produce expression vectors. Such expression vectors will include the polynucleotides necessary to support production of contemplated cytotoxic proteins and polypeptides within any host cell of choice or cell-free expression systems (e.g. pTxb1 and pIVEX2.3). The specific polynucleotides comprising expression vectors for use with specific types of host cells or cell-free expression systems are well known to one of ordinary skill in the art, can be determined using routine experimentation, or may be purchased.

The term "expression vector," as used herein, refers to a polynucleotide, linear or circular, comprising one or more expression units. The term "expression unit" denotes a polynucleotide segment encoding a polypeptide of interest and capable of providing expression of the nucleic acid segment in a host cell. An expression unit typically comprises a transcription promoter, an open reading frame encoding the polypeptide of interest, and a transcription terminator, all in operable configuration. An expression vector contains one or more expression units. Thus, in the context of the present invention, an expression vector encoding a cytotoxic fusion polypeptide comprising a single polypeptide chain (e.g. a scFv genetically recombined with a Shiga toxin ribotoxic region) includes at least an expression unit for the single polypeptide chain, whereas a cytotoxic fusion protein comprising, e.g. two or more polypeptide chains (e.g. one chain comprising a $V_L$ domain and a second domain comprising a $V_H$ domain linked to a ribotoxic region) includes at least two expression units, one for each of the two polypeptide chains of the protein. For expression of multi-chain cytotoxic proteins, an expression unit for each polypeptide chain may also be separately contained on different expression vectors (e.g. expression may be achieved with a single host cell into which expression vectors for each polypeptide chain has been introduced).

Expression vectors capable of directing transient or stable expression of polypeptides and proteins are well known in the art. The expression vectors generally include, but are not limited to, one or more of the following: a heterologous signal sequence or peptide, an origin of replication, one or more marker genes, an enhancer element, a promoter, and a transcription termination sequence, each of which is well known in the art. Optional regulatory control sequences, integration sequences, and useful markers that may be employed are known in the art.

The term "host cell" refers to a cell which can support the replication or expression of the expression vector. Host cells may be prokaryotic cells, such as *E. coli* or eukaryotic cells (e.g. yeast, insect, amphibian, bird, or mammalian cells). Creation and isolation of host cell lines comprising a polynucleotide of the invention or capable of producing a cytotoxic proteins and polypeptide of the invention can be accomplished using standard techniques known to the skilled worker.

The term "cell free translation" refers to the production of a polypeptide from a nucleic acid encoding it in the absence of any intact cell. Commonly, cell free translation systems comprise cellular extracts with functioning ribosomes from either prokaryotic or eukaryotic species. Methods of chemical polypeptide synthesis for semi-synthetic or fully synthetic production are within the scope of the term "cell free translation." Chemical methods of polypeptide synthesis include the creation of synthetic polypeptides using chemical methods such as, e.g., ligation of smaller polypeptides and/or peptides into larger polypeptides. Non-limiting examples of chemical ligation reactions include native chemical ligations using inteins or Staudinger reactions. Determining and optimizing a cell free translation system to produce a cytotoxic protein or polypeptide of the invention can be accomplished using standard techniques known to the skilled worker.

EXAMPLES

The following examples demonstrate certain embodiments of the present invention. However, it is to be understood that these examples are for illustration purposes only and do not intend, nor should any be construed, to be wholly definitive as to conditions and scope of this invention. The experiments in the following examples were carried out using standard techniques, which are well known and routine to those of skill in the art, except where otherwise described in detail.

The following examples of protein display screening of polypeptide expression libraries involving ribotoxic polypeptides demonstrate the improved effectiveness and efficiency of using a reduced ribotoxic and/or non-ribotoxic context when screening, enriching, identifying, and developing polypeptides comprising ribotoxic regions. These examples of protein display screening with reduced or abolished ribotoxin activity show robust exemplary methods for screening, selecting, and identifying cytotoxic chimeric polypeptides because library sizes may be relatively large and screening may be performed in one-step in the context of fusion polypeptides comprising both cell-targeting binding regions and ribotoxic regions.

The present invention was discovered while performing screening related to methods described in WO2005/092917, WO2007/033497, US 2007/0298434, US 2009/0156417, EP1727827, EP2228383, EP2402367, US 2013/0196928, and EP1945660. It was unexpectedly discovered that the presence of ribotoxicity in a library of displayed polypeptides severely reduced the binding signal while screening using an in vitro binding assay and caused a strong unwanted selection bias toward exceptionally rare spontaneous mutants in the catalytic domain of the ribotoxic region.

In Example 5, in vitro display screening of an unmodified ribotoxic expression library (i.e. fully ribotoxic) returned a single predominant polypeptide which comprised a spontaneous mutation which inactivated the catalytic activity of the ribotoxic region representing a false positive. Phage clones displaying polypeptides comprising catalytically inactivated ribotoxic regions showed 1.7 to 2.9 times greater binding signal in a phage-ELISA as compared to a positive control comprising an identical binding region and a wild-type, toxin-derived ribotoxic region with full catalytic activity. This unwanted selection bias and false positive problem is solved by reducing or eliminating the ribotoxicity of the ribotoxic region in the expression library and the displayed fusion polypeptides during screening.

This was surprising that an in vitro selection assay based on binding affinity was significantly disrupted by the presence of a ribotoxic component. Without being bound by theory, this strong selection bias toward catalytically inactivated toxin components may represent a false positive caused by propagation advantage imparted by the reduction or elimination of ribotoxicity (see Vodnik M et al., *Molecules* 16: 790-817 (2011)). Growth rate differences of only a few percent can destroy diversity in phage libraries and enrich libraries for clones independent of selected-for phenotypes and often result in convergence on a small number of clones (Derda R et al., *Molecules* 16: 1776-1803 (2011)). The unexpected false positive rate can be significantly diminished by reducing or eliminating the ribotoxicity of the polypeptides encoded by the library prior to screening-perhaps by allowing for more optimal and/or uniform growth kinetics among individual phage library clones.

The following examples of protein display screening of recombinant, fusion polypeptides comprising ribotoxin derived regions in a reduced and/or non-ribotoxic context show that single-step screening may be performed for polypeptides which not only have desired selectable characteristic(s) but also have desired expression and stability and other production characteristics. These methods provide for efficient, effective, and powerful screening that avoids unwanted selection biases resulting from ribosome inactivation by the ribotoxic region such as, e.g., false positives.

Example 1. Creation of Cytotoxic Polypeptide Templates Encoding Ribotoxic Regions with Reduced Ribotoxicity for Protein Display Screening Ribotoxic polypeptides derived from the A Subunit of Shiga-like toxin 1 (SLT-1; SEQ ID NO:1) were used to design cell-targeted, cytotoxic, fusion-polypeptide templates for phage display screening. Three catalytically inactive forms of the ribotoxic region SLT-1A (Y77S, E167D, and Y77S/E167D) were created by introducing two amino acid substitutions separately and in combination (see Hovde, *Proc Natl Acad Sci USA* 85: 2568-72 (1988); Deresiewicz, *Biochemistry* 31: 3272-80 (1992)). A polynucleotide encoding a ribotoxic region derived from the A subunit of Shiga-like toxin 1 (SLT-1A) inserted into a pECHE9A plasmid was obtained (Cheung, *Mol Cancer* 9: 28 (2010)). The Y77S mutation was introduced into the SLT-1A ribotoxic region polypeptide by site directed mutagenesis of the polynucleotide encoding the polypeptide using the QuikChange Lightning Site-Directed Mutagenesis Kit (Agilent Technologies, Inc., Santa Clara, Calif., U.S.). In the same manner, an E167D mutation was introduced alone and in combination with the Y77S mutation. The mutagenesis reactions were performed according to the manufacture's protocol except that mutated plasmids were transformed into NEB 5-alpha Competent *E. coli* (High Efficiency) (New England Biolabs, Ipswich, Mass., U.S.). The polynucleotides encoding the three catalytically inactive toxin effectors (Y77S, E167D, and Y77S/E167D) were inserted into vectors for phage library screening such that binding regions were fused in-frame to produce templates for identifying putative chimeric cytotoxic polypeptides. The polynucleotide sequences of the resulting polynucleotides which encoded the three catalytically inactive toxin effectors (Y77S, E167D, and Y77S/E167D) were confirmed by Sanger sequencing (Functional Biosciences, Madison, Wis., U.S.). Variants are indicated as SLT-1A-D for E167D mutation; SLT-1A-Y for Y77S mutations and SLT-1A-DY for double E167D/Y77S mutations. The polynucleotides encoding chimeric polypeptides comprising binding regions and ribotoxic regions (whether modified or unmodified) often included sequences encoding a terminal biochemical tag, such as, e.g., an amino-terminal myc tag to facilitate detection of the encoded polypeptide.

A group of exemplary cytotoxic polypeptides comprising a binding region and ribotoxic region was created for testing purposes (αHER2scFv::SLT-1A). The binding region αHER2scFv was an immunoglobulin-type binding region derived from the immunoglobulin 4D5 trastuzumab (Zhao et al., *J Immunol* 183: 5563-74 (2009); marketed as Herceptin® by Genentech, Inc., South San Francisco, Calif., U.S.)). The binding region αHER2scFv comprised a single-chain variable fragment (scFv) created with the two immunoglobulin variable regions ($V_L$ and $V_H$) separated by a linker. The αHER2scFv polynucleotide was cloned in-frame with a polynucleotide encoding a "hinge" region of a murine immunoglobulin-G (IgG), and a polynucleotide encoding a SLT-1A ribotoxic region, such as SLT-1A or a catalytically inactive SLT-1A, to produce αHER2scFv::SLT-1A or catalytically inactivated variants thereof (αHER2scFv::SLT-1A-Y, αHER2scFv::SLT-1A-D, and αHER2scFv::SLT-1A-DY).

Similar to the creation of the HER2 targeting polypeptide group above, another set of exemplary cytotoxic polypeptides is created which comprise the immunoglobulin-type binding region (αSLAMF7scFv) capable of binding human SLAMF7. A polynucleotide encoding the αSLAMF7scFv is fused in-frame with toxin template polynucleotides comprising SLT-1A ribotoxic regions, such as SLT-1A or a catalytically inactive SLT-1A, to produce αSLAMF7scFv::SLT-1A or catalytically inactivated variants thereof. A polynucleotide encoding the αSLAMF7scFv was fused in-frame with the polynucleotide template comprising a catalytically inactive SLT-1AY77S, to produce the catalytically inactive αSLAMF7scFv::SLT-1A-Y variant.

A third group of exemplary cytotoxic polypeptides was created with an immunoglobulin-type binding region (αCD20scFv) capable of binding human CD20 fused to SLT-1A ribotoxic regions by joining polynucleotide templates encoding SLT-1A ribotoxic regions and scFvs capable of binding CD20. The catalytically inactive polypeptide αCD20scFv::SLT-1A-Y77S variant was created from a fusion of polynucleotide templates encoding a αCD20 scFv and encoding a ribotoxic region SLT-1AY77S.

For the above templates and polynucleotides encoding exemplary cytotoxic polypeptides, codon optimization was performed by DNA 2.0 (Melno Park, Calif.) for efficient expression in *E. coli*. Some constructs comprised a mutation of the natively occurring cysteine at position 242 of the SLT-1A ribotoxic region, whether modified or unmodified, that had no apparent effect on the assays described in the Examples.

Example 2. Phage Display of Non-Ribotoxic Versus Ribotoxic Polypeptides

Various templates comprising ribotoxic regions with reduced and/or eliminated ribotoxicity as described in Example 1 were used in a phage display assay to compare with fully ribotoxic variants. Various polynucleotides encoding the groups of exemplary cytotoxic polypeptides comprising SLT-1A fused with an scFv targeting HER2 and exemplary catalytically inactivated derivatives thereof were loaded into a T7 phage display system. In particular, polynucleotides encoding the catalytically inactivated, ribotoxic polypeptides αSLAMF7scFv::SLT-1A-Y and αCD20scFv::SLT-1A-Y77S were loaded into a T7 phage display system.

The cloning, packaging, and amplifying of phage were performed essentially as described in the T7Select System Manual (Novagen, Billerica, Mass., U.S.). Polynucleotides encoding exemplary cytotoxic polypeptide templates were cloned into T7Select 1-2c (low copy) vectors to generate a phage expression library using the T7Select System (Novagen, Billerica, Mass., U.S.). The cytotoxic polypeptide templates comprised SLT-1A derived ribotoxic regions, either modified (catalytically inactivated) or unmodified (wild-type), and the exemplary binding regions αHER2, αSLAMF7, or αCD20scFv. A packaging reaction was performed and the resulting phage were plated on *E. coli* for tittering and isolation of individual phage clones. Three phage clones of each encoding an exemplary template or catalytically inactive, putative cytotoxic polypeptide were analyzed by Sanger sequencing (Functional Biosciences, Madison, Wis., U.S.) to confirm the polynucleotides inserted into the phage genomes. Monoclonal phage were amplified for αHER2scFv::SLT-1A, αHER2scFv::SLT-1A-Y, αHER2scFv::SLT-1A-D, αHER2scFv::SLT-1A-DY, αSLAMF7scFv::SLT-1A-Y and αCD20scFv::SLT-1A-Y77S. Amplification of low titer monoclonal phage involved incubation of the phage with small scale volumes (1 mL) of bacterial hosts until the host cells lysed and, then, the addition of lysates to a larger host culture for further amplification. The amplified phage populations were purified and sterile-filtered using a 0.45 micron filter (Millipore, Billerica, Mass., U.S.).

The screening, selection, and enrichment of phage in the following Examples were performed essentially as described in the T7Select System Manual (Novagen, Billerica, Mass., U.S.).

The phage display binding signal of phage expression clones described in this Example was tested using an enzyme-linked immunosorbent assay (ELISA). ELISA using whole phage displaying polypeptides ("phage ELISA") was applied to phage to characterize the binding characteristics of several phage displayed polypeptides to extracellular target biomolecules. For some experiments of this Example, the exemplary non-ribotoxic polypeptide αCD20scFv::SLT-1A-Y comprising αCD20scFv fused to a catalytically inactive ribotoxic region (SLT-1A Y77S) was used as a negative control.

Phage ELISA was performed on monoclonal T7 phage populations displaying the exemplary cytotoxic polypeptide αHER2scFv::SLT-1A or polypeptides comprising catalytically inactivated SLT-1A ribotoxic regions generated using the mutant SLT-1A templates fused to the same scFv targeting HER2 (αHER2scFv): αHER2scFv::SLT-1A-D, αHER2scFv::SLT-1A-Y and αHER2scFv::SLT-1A-DY. Phage ELISA was performed using the extracellular portion of recombinant human HER2 and the extracellular portion of recombinant human EGFR, a closely related protein, as a negative control. Phage displaying the exemplary cytotoxic polypeptide αHER2scFv::SLT-1A served as a positive control because this polypeptide bound to HER2 with high affinity and kills HER2 expressing cells when produced and tested outside any phage display system.

The phage ELISA assay was performed in 96-well, MaxiSorp® ELISA plates (Nunc, Rochester, N.Y., U.S.) which were coated overnight at 4 degrees Celsius (° C.) with 100 nanogram (ng) per well of either HER2-Fc or EGFR-Fc (R and D Systems, Minneapolis, Minn., U.S.) in phosphate buffered saline (PBS). The wells were washed with PBS-T (PBS with 0.1% Tween-20) and then non-specific binding was blocked by incubating the wells with 3 percent milk in PBS-T at room temperature (RT). The wells were washed with PBS-T, and then $2\times10^9$ plaque forming units (pfu) of each phage population in 3%-milk PBS-T was added to wells. After incubating the phage with the coated wells at RT, the wells were washed with PBS-T. Then, the wells were incubated at RT with an antibody recognizing a T7 phage capsid protein conjugated to horseradish peroxidase (HRP) (T7•Tag® Antibody HRP Conjugate, Novagen, Billerica, Mass.). The wells were washed with PBS-T, and then Pierce Ultra TMB (Thermo Fisher Scientific, Rockford, Ill., U.S.) was added to each well to allow HRP reactions to occur for 30 minutes at RT. The reactions were quenched with acid. The plates were read for absorbance of light set to a wavelength of 450 nanometers using a plate reading device. The data were analyzed using Prism software (GraphPad Software, San Diego, Calif., U.S.).

The results of the phage ELISA experiments are shown in FIG. 2. All the tested phage populations bound with specificity to HER2-Fc as compared to EGFR-Fc. Surprisingly, the three phage displaying polypeptides comprising mutant ribotoxic regions displayed a much higher binding signal toward HER2-Fc in the assay than the exemplary cytotoxic polypeptide αHER2scFv::SLT-1A comprising a fully active ribotoxic region. For all displayed polypeptides tested, binding to EGFR-Fc was equal or below background levels (see the negative control αCD20scFv::SLT-1A-Y in FIG. 2).

Example 3. Creation of Diverse Phage Expression Libraries Using Immunoglobulin-Type Binding Regions Derived from Immunized Mice In this example, a diverse phage display expression library was created using a set of biased, mammalian, immunoglobulin sequences for the cell-targeting, binding region and a catalytically inactive ribotoxic region for the toxin-derived region. Nucleic acids encoding immunoglobulin domains were isolated from the B-cells of immunized mice to create a diverse cytotoxic polypeptide expression library comprising immunoglobulin-type domains and catalytically inactive ribotoxic region.

BALB/C mice were immunized with target antigens. After confirmation of positive immune response, B-cells were isolated from splenocytes. Total RNA was extracted from the B-cells and used to synthesize complementary DNA (cDNA). The variable portion of the heavy ($V_H$) and light ($V_L$) chains of immunoglobulin sequences in the cDNA were amplified and purified by PCR using a primer set derived from published sequences (Imai et al., *Biol Pharm Bull* 29: 1325-30 (2006)). Single-chain, variable fragments (scFvs) were produced using overlap PCR reactions which added a linker sequence between the $V_H$ and $V_L$ regions. A library of polynucleotides encoding these scFvs was cloned into a phage vector in-frame with catalytically inactive forms of the ribotoxic region SLT-1A using the templates described in Example 1. A diverse library of T7 phage displaying polypeptides comprising the scFvs and the catalytically inactive form of SLT-1A-Y77S was cloned, packaged, and amplified as described in Example 1. The amplified library was calculated to have a diversity of $5.7 \times 10^6$ with an amplification factor of $2.6 \times 10^4$ pfu per milliliter (pfu/mL).

Biopanning by selecting for specific protein interactions was performed on this library essentially as described in the T7Select System Manual (Novagen, Billerica, Mass., U.S.). Briefly, recombinant target proteins were immobilized onto a solid support and blocked with milk. The phage library was incubated with the target proteins and then washed thoroughly. Any phage which bound to the target protein under these conditions was eluted with 1% sodium dodecyl sulfate (SDS) or by amplification of bound phage using BLT 5403 or BLT 5615 bacteria. After three rounds of amplification, individual phage clones were isolated and their insert DNA sequenced. Binding of monoclonal phage populations was confirmed by the binding assay described in Example 3 using the appropriate target molecule.

Example 4. Phage Display Screening Fully-Ribotoxic Expression Libraries

A diverse expression library of cytotoxic polypeptides was screened using the phage display biopanning method as described in Example 3 using an extracellular portion of human HER2 as the phage ELISA bait. The library comprised polypeptides with peptide binding regions fused to fully catalytically active ribotoxic regions.

PCR products from phage enriched by the screen were sequenced to identify the polypeptide sequences of selected binders (positive hits). One positive hit was observed to have a spontaneous mutation located at the natively occurring amino acid residue position 77 of SLT-1A (Y77H) (FIG. 3).

This spontaneous mutation was predicted to result in catalytic inactivation similar to the better studied Shiga toxin A Subunit mutation Y77S (Deresiewicz R et al., *Biochemistry* 31: 3272-80 (1992); Deresiewicz R et al., *Mol Gen Genet* 241: 467-73 (1993)). This prediction was correct because a SLT-1A ribotoxic region polypeptide comprising Y77H showed greatly attenuated ribosome inhibition as compared to the wild type SLTA 1-251 ribotoxic region polypeptide SLT-1A (FIG. 4).

The ribosome inactivation capabilities of SLT-1A-Y77H compared to wild-type SLT-1A were determined in a cell-free, in vitro protein translation assay using the TNT® Quick Coupled Transcription/Translation Kit (L1170 Promega, Madison, Wis., U.S.). The kit includes Luciferase T7 Control DNA and TNT® Quick Master Mix. The ribosome activity reaction was prepared according to the manufacturer's instructions to create "TNT" reaction mixtures. Series of 10-fold dilutions of SLT-1A-Y77H versus SLT-1A to be tested were prepared in appropriate buffer and series of identical TNT reaction mixture components were created for each dilution. Each sample in each dilution series was combined with each of the TNT reaction mixtures along with the Luciferase T7 Control DNA. The test samples were incubated for 1.5 hours at 30° C. After the incubation, Luciferase Assay Reagent (E1483 Promega, Madison, Wis., U.S.) was added to all test samples and the amount of luciferase protein translation was measured by luminescence according to the manufacturer instructions. The level of translational inhibition was determined by non-linear regression analysis of log-transformed concentrations of total protein versus relative luminescence units. Using statistical software (GraphPad Prism, San Diego, Calif., U.S.), the half maximal inhibitory concentration ($IC_{50}$) value was calculated for each sample.

The polypeptide SLT-1A-Y77H showed greatly attenuated ribosome inhibition as compared to SLT-1A (FIG. 5). These results showed that screening ribotoxic polypeptides in a fully active environment can result in a selection bias toward spontaneous ribotoxicity inactivating mutations and away from the desired library members comprising cytotoxic polypeptides with fully ribotoxic regions. It was unexpected that when selecting for binding affinity using an in vitro phage display system, the ribotoxicity of the ribotoxic region caused such a significant perturbation, presumably via biases in phage clone representation, that false positive clones were recovered which resulted from rare, spontaneously mutations which disrupted the catalytic activity of the ribotoxic region (see FIGS. 2 and 3).

Example 5. Phage Display Screening a Non-Ribotoxic Library Showed Enrichment for Target Binding Clones A phage expression library of non-ribotoxic polypeptides was screened using phage ELISA to select for high-affinity binding to SLAMF7 as described in Example 3. An extracellular part of human SLAMF7 (amino acid residues 1-226, recombinant human SLAMF7, catalog no. 11691-H08H, Sino Biological, Beijing, P.R.C.) was used as the phage ELISA "bait." All displayed polypeptides in the library had the Y77S mutation in the Shiga toxin ribotoxic region (SLT-1A-Y) to eliminate ribotoxic region catalytic ribotoxicity.

Binding regions targeting SLAMF7, α-SLAMF7-V1 and α-SLAMF7-V2, and HER2, α-HER2scFv, fused to SLT-1A-Y were used in this assay. Two scFv-SLT-1A fusions were used as positive "hits" when screening the library for binding affinity to the extracellular part of human SLAMF7, each comprising different scFv components named: SLAMF7-V1 and SLAMF7-V2. Both αSLAMF7-V1::SLT-1A and αSLAMF7-V2::SLT-1A bound to the extracellular portion of recombinant SLAMF7 but with different affinities when tested as isolated polypeptides independent of a phage display system.

A pool of phage was created in which the total phage population intentionally comprised 10% αSLAMF7-V1::SLT-1A, 10% of αSLAMF7-V2::SLT-1A, and 80% of αHER2::SLT-1A-Y. This was accomplished by mixing $1 \times 10^{10}$ pfu of αSLAMF7-V1::SLT-1A-Y and $1 \times 10^{10}$ pfu αSLAMF7-V2::SLT-1A-Y with $8 \times 10^{10}$ pfu of αHER2::SLT-1A-Y.

This phage display library was screened as described in Example 3 using an extracellular portion of human SLAMF7 as the phage ELISA bait for three consecutive rounds of biopanning. The first round used only a positive selection panning step (SLAMF7 target) and the second and third rounds included a negative selection depletion step (CEA) prior to positive screening.

In the first round of biopanning, 500 ng of recombinant human SLAMF7-HIS (Sino Biological, Beijing, P.R.C.) was coated onto 96-well MaxiSorp® ELISA plates in PBS and allowed to bind overnight at 4° C. The wells were washed with PBS-T and then non-specific binding was blocked by incubating the wells with 3 percent milk in PBS-T at room temperature (RT). The wells were washed with PBS-T, and then $1 \times 10^9$ pfu of the library suspended in 3%-milk PBS-T was added to wells. After incubating the phage with the coated wells at RT for 30 minutes, the wells were washed five times with PBS-T and then five times with PBS.

To elute bound phage, 200 microliters (µL) diluted BLT5615 induced with IPTG was added to the wells and the plates were incubated at 37° C. with shaking until bacterial lysis occurred. Samples of the solution in the wells were transferred to microfuge tubes containing 20 µL of 5 molar sodium chloride (NaCl) and briefly vortexed. Then, the microfuge tubes were centrifuged at 10,000 times gravity for 5 minutes to remove bacterial debris. The supernatants were transferred to clean microfuge tubes, and phage was precipitated. Phage were precipitated by adding 300 µL of PBS and 100 µL of 50% polyethylene glycol and incubating the microfuge tubes on ice for 1 hour. Precipitated phage was collected by centrifugation at 10,000 times gravity for 10 minutes at 4° C. and removal of the supernatant. The phage were resuspended in 250 µL PBS and vortexed well. Bacterial debris was removed by centrifugation at 12,000 times gravity for 10 minutes. The purified phage were titered using standard methods and then used for the next round of screening.

The second and third rounds of biopanning were conducted in a similar manner except that a negative selection step was added where the phage display library was allowed to bind to an irrelevant target (recombinant human carcinoembryonic antigen (CEA), Sino Biological, Beijing, P.R.C.) for 30 minutes at RT prior to being added to the positively selected binding human SLAMF7.

To determine the percentage representation of each phage clone within the selected phage display library, a PCR based analysis was designed and conducted. The assay involved a general primer that bound upstream of the displayed polypeptide coding region for all constructs and specific PCR primers that bound within the specific scFvs, such as, e.g., HER2 and SLAMF7. PCR reactions containing all the primers and a single individual phage resulted in a single PCR product of the predicted size. The assay was successfully designed to produce a banding pattern that was different for each individual phage in the pool such that discrimination of specific phage was possible in a mixed pool.

Isolated phage were harvested from tittering plates for each round of biopanning and incubated in PBS at RT to allow for diffusion into solution. Aliquots of the phage isolate solution were analyzed using the PCR setup described above. Each phage isolate produced a PCR product band on an electrophoretic gel of predicted size to represent the coding sequence for αHER2scFv, αSLAMF7-V1scFv, and αSLAMF7-V2. The percentage of phage represented in the starting pool and each round 1-3 is shown in FIG. 5. The enrichment of phage containing a αSLAMF7scFV was observed after each round of biopanning (FIG. 5). Both phage clones capable of binding to SLAMF7, αSLAMF7-V1::SLTA-Y and αSLAMF7-V2::SLTA-Y, were enriched and the percentage of the non-binding phage, αHER2::SLTA-Y, was reduced over three rounds (FIG. 5). The phage clone displaying αSLAMF7-V1::SLTA-Y variant which showed the highest affinity to binding SLAMF7 when assayed outside of any phage display system, was preferentially enriched by the rounds of selective biopanning as evidence by an increased percentage of representation in earlier rounds and increasing total percentage of representation in each round (FIG. 5).

These results showed the effectiveness of using catalytically inactive, mutant ribotoxin templates for creation of expression libraries and for screening characteristics such as, e.g., binding affinity. In addition, these results suggest that phage-ELISA binding assay screening of ribotoxic polypeptides is more optimally performed in general when using ribotoxic regions with reduced or eliminated ribotoxicity as compared to more ribotoxic, ribotoxic regions. Without being bound by theory, the improved results using the non-ribotoxic library might be the result of increased and/or uniform viability of all the phage displaying the expression library when the ribotoxicity is reduced or eliminated as compared to displaying catalytically active ribotoxic polypeptides. Again without being bound by theory, an alternative but not mutually exclusive explanation is the improved results using the non-ribotoxic library might be the result of the display of an increased copy number of reduced-ribotoxicity or non-ribotoxic polypeptides per phage as compared to the copy number displayed per phage for fully ribotoxic polypeptides.

Example 6. Phage Display Screening a Diverse, Non-Ribotoxic Library

A diverse expression library of non-ribotoxic polypeptides was screened by phage display for high-affinity binding to SLAMF7 as described in Example 5 to test for enrichment of a non-ribotoxic, SLAMF7-binding polypeptide during biopanning. The diverse phage expression library for screening was created by adding $2.6 \times 10^4$ pfu of the monoclonal αSLAMF7-V2::SLTA-Y to $6.5 \times 10^1$ pfu of the diverse library of Example 3 in 1 mL total volume in order to match the representation of αSLAMF7-V2::SLTA-Y to a single scFv displaying phage clone in the library (0.00004%).

Figure 6:
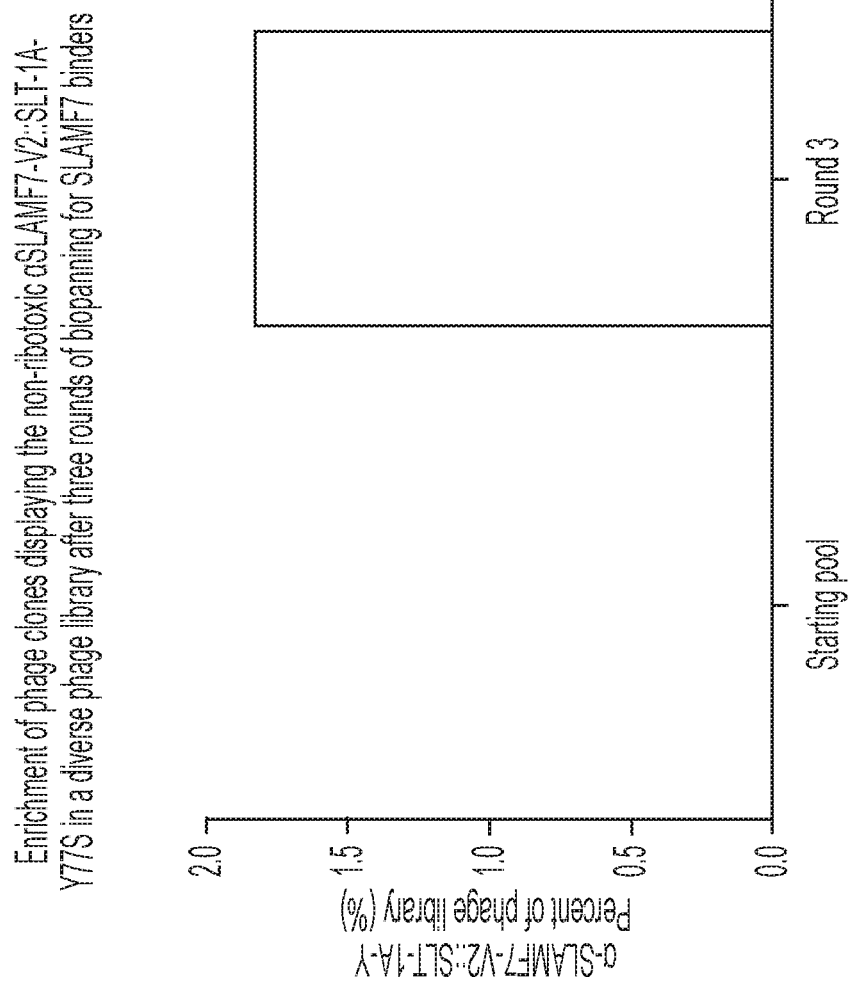
FIG. 6 shows the successful enrichment of phage displaying a chimeric polypeptide which binds the selected target biomolecule SLAMF7 within a diverse phage display library designed with mutated ribotoxic regions to reduce or eliminate ribotoxicity via catalytic inactivation.

Three rounds of biopanning was performed as using phage ELISA as described in Example 5 to select for phage binding to recombinant human SLAMF7. After three rounds of biopanning, individual phage isolates were harvested and subjected to PCR analysis of their ribotoxic regions. PCR products were sequenced to reveal that αSLAMF7-V2::SLTA-Y phage clones were recovered in 2 out of 110 phage isolates (FIG. 6). This result indicated that phage-ELISA biopanning could select target specific binding phage (SLAMF7-binding) from a diverse phage display library displaying chimeric ribotoxic polypeptides with mutated ribotoxic regions to reduce or eliminate ribotoxicity. Thus, these examples demonstrate that intentionally reducing and/or eliminating the ribotoxicity of the displayed polypeptides during phage expression library construction prevents the unwanted selection bias created by the presence of ribotoxic polypeptides and allows for the phage display system to enrich for the desired target-binding phage instead of enriching for phage clones displaying rare, spontaneous mutants which inactivate ribotoxic regions and/or lack target binding.

Example 7. Phage Display Screening Diverse, Non-Ribotoxic Libraries Versus Diverse, Ribotoxic Libraries SLAMF7 is a cell surface protein, also known as CS1, CD2-like receptor activating cytotoxic cells (CRACC), and CD319, which is overexpressed by human myeloma cells (Xie Z et al., *Oncotarget* 4: 1008-18 (2013)). Phage display screening is performed using an expression library constructed with a catalytically inactivated ribotoxic region as described in Example 1 and a diverse immunoglobulin-derived region as described in Example 3. The biopanning selection steps are performed as described in Example 6 using the malignant cell marker SLAMF7 for the ELISA bait. Chimeric fusion polypeptides are identified which bind to SLAMF7 with high affinity and comprise an inactivated ribotoxic region.

The identified chimeric fusion polypeptides are mutated such that catalytic activity of the ribotoxic region is restored. The resulting polypeptides are tested in vitro for ribosome inactivation activity and target-cell binding. The fusion polypeptides for which ribotoxicity and target-cell binding is confirmed are then tested in vivo for cytotoxicity. Certain polypeptides identified using this method are cytotoxic fusion polypeptides comprising a single-chain, variable fragment, binding region capable of binding SLAMF7 with high affinity recombinantly fused with a Shiga toxin A Subunit derived ribotoxic region. These αSLAMF7-binding cytotoxic polypeptides are capable of selectively killing cells that express SLAMF7 at a cellular surface by promoting cellular internalization, subcellular routing, and ribosome inactivation by the Shiga toxin-derived, ribotoxic region.

Starting with an expression library of ribotoxic polypeptides might weaken the phage ELISA signal of phage displaying ribotoxic polypeptides as compared to phage displaying non-ribotoxic polypeptides so much that during screening the ribotoxic region is under intense selective pressure to generate mutations, such as, e.g., catalytically inactive mutants which appear as a strong false positive signal in phage-ELISA selection steps. The weakened signal might be caused by reductions in propagation rates, copy number displayed, and/or stability of the starting sequences. This hypothesis is tested by comparing ribotoxic libraries to non-ribotoxic libraries.

Using equal starting titers of a SLAMF7-binding phage clone identified in this Example and a phage clone displaying the same fusion polypeptide which is ribotoxic, the robustness and efficiency of screening reduced ribotoxicity or non-ribotoxic phage is compared to screening fully ribotoxic phage. The cloning, packaging, and amplifying of phage are performed using the T7Select System. The two clones are prepared with equivalent starting titers as part of a diverse expression library as described in Example 6. The entire diverse library is enriched while monitoring the representation of the two clones as described in Example 6.

The phage resulting from the phage clone displaying the fusion polypeptides comprising a catalytically inactive ribotoxic region (Y77/E167) have higher titers, fewer spontaneous mutations, and fewer truncations, caused by mutations which generate stop codons, during the packaging step and the amplification step as compared to the phage clone with a fully ribotoxic region. This result supports the idea that catalytically inactive variants improve phage display, expression library construction and phage display library expression.

Two separate diverse phage libraries are created from the same scFv template library as described in Example 4 for phage display screening except by varying the SLT-1A component slightly. One library uses a polynucleotide encoding a fully ribotoxic SLT-1A polypeptide to create a phage display library of ribotoxic fusion polypeptides, and the other library uses a polynucleotide encoding a catalytically inactive SLTA-1A polypeptide (Y77/E167) to create a phage display library of non-ribotoxic fusion polypeptides.

Using equal starting titers, the two libraries are screened in parallel as described in Example 6. The phage clones identified in the two screens as high-affinity SLAMF7 binders will have higher titers, fewer spontaneous mutations, and fewer truncations, caused by mutations which generate stop codons, in the screen of the non-toxic library as compared to the screen of the fully ribotoxic library. The results of this Example support the idea that reduced ribotoxicity and non-ribotoxic variants improve the entire process of phage display screening and that this can be accomplished by designing in one or more specific mutations which result in the catalytic inactivation of the ribotoxic region.

Example 8. RNA Display Screening a Non-Ribotoxic Library Comprising a Ribotoxic Polypeptide Derived from Diphtheria Toxin A polynucleotide construct is created or obtained which encodes a diphtheria toxin (DT) derived ribotoxic region which is catalytically inactivated via one or more mutations (see e.g. SEQ ID NOs: 17-19). Alternatively, a polynucleotide construct is created or obtained which encodes a ribotoxic, DT ribotoxic region (such as, e.g., comprising the amino acid sequence of SEQ ID NO:5), and then one or more alterations are made to the polynucleotide to create a reduced ribotoxicity and/or non-ribotoxic variant(s). For example, alterations that result in the polynucleotide construct encoding a DT ribotoxic region variant with one or more of the following amino acid residue substitutions at the natively positioned amino acid residue(s): W50A, Y65A, D148A, and/or W153A. These amino acid residue substitutions and/or others at positions such as, e.g., at histidine-21, tyrosine-27, glycine-52, and/or tyrosine-54, may be selected to severely attenuate or eliminate DT enzymatic activity without significantly changing the overall structure of the DT ribotoxic region polypeptide.

The polynucleotide construct is designed not to encode a polypeptide which comprises any functional cell binding region from a native diphtheria toxin. In addition, the DT construct may optionally comprise modifications to natively positioned amino acid residues 6-8, 28-30, and/or 289-291, such as, e.g., V7T, V7N, V7D, D8N, S9A, S9T, S9G, V28N, V28D, V28T, D29N, S30G, S30N, I290T, S292A, S292G and/or S292T as described by US 2009/0010966.

This reduced ribotoxicity and/or non-ribotoxic DT polynucleotide construct is used as a template nucleic acid for generating protein display expression libraries of the invention encoding fusion polypeptides comprising modified DT ribotoxic regions and binding regions.

In this example, diverse RNA display libraries are created using the modified DT toxin effector template fused to nucleic acids encoding binding regions derived from the immunoglobulin genes from a non-human chordate. A diverse nucleic acid library is generated with each member designed to have the following sequences (from 5' to 3'): a T7 RNA polymerase promoter, a TMV translation enhancer, a modified DT ribotoxic region coding sequence, a binding region coding sequence, and an amino-terminal FLAG tag coding sequence. The binding region is specifically oriented carboxy-terminal to the ribotoxic region.

Immune cells are harvested from a non-human chordate and lysed. For example, chordates may be immunized by repeated subcutaneous injections (e.g. 6 times over 6 month period) with purified target biomolecules, tumor cells, or intracellular pathogens multiple times. Then 50 milliliters (mL) of anti-coagulated blood can be collected in order to isolate plasma and peripheral blood lymphocytes or spleen and lymph node tissues can be harvested. The non-human chordate donor can be a transgenic organism which comprises humanized immunoglobulin sequences.

Total RNA is isolated from the chordate immune cell lysate using the RNeasy RNA isolation kit according to the manufacturer's protocol (Qiagen, Valencia, Calif., U.S.). A library of complementary DNA (cDNA) is generated using degenerate primers, such as, e.g., random decamers, oligo (dT), and/or TTNNNNNN primers. Reverse transcription of 2 micrograms of total RNA is performed using the RETROscript Kit (Ambion, Austin, Tex., U.S.) according to the manufacturer's instructions. The mRNA template is isolated using treatment with RNase H.

Following cDNA library synthesis, CDRH3 diversity is amplified from the cDNA using PCR. The resulting PCR products are gel purified and inserted into human heavy chain germline V-regions and human light chain germline V-regions (see e.g. Kato M, Hanyu Y, *J Immunol Methods* 396: 15-22 (2013)). Diverse synthetic combinatorial libraries are created using random mutagenesis of the entire immunoglobulin-derived region or a subregion, e.g. a template cassette encoding just a $V_H$ and/or a $V_L$ region. The library can be diversified using random mutagenesis, such as, e.g., error-prone PCR, DNA shuffling, random insertion and deletion, and random insertional-deletional strand exchange (see e.g. Raipal A et al., *Proc Natl Acad Sci USA* 102: 8466-71 (2005); Nishi M et al., *J Immunol Methods* 2014: Jul. 8 (2014)). The random mutagenesis may be completely random or partially random, such as, e.g., by using trinucleotides which are random except for not coding a stop signal in order to maintain codon structure and open reading frame. A pool of dsDNA molecules representing the randomized scFv population is recovered, and blunted with T4 DNA polymerase.

The chordate scFv encoding nucleic acid library is linked to the nucleic acid encoding the modified DT ribotoxic region. A diverse nucleic acid library is generated with each member designed to encode a modified DT ribotoxic region fused to a scFv binding region. Then, a linker is directionally ligated to the dsDNA library members. Two cassettes are ligated to the dsDNA library members, a T7 promoter, a 5' untranslated region (UTR) to improve in vitro transcription in eukaryotic cell free expression systems, a FLAG tag encoding sequence, and sequences designed for hybridizing with a puromycin-containing oligo linker. This diverse library of chimeric DT ribotoxic region fused to a variety of scFvs may have $1 \times 10^{10}$ unique members or more.

RNA display is accomplished by forming a peptide bond within the ribosome between the last amino acid residue of each nascent polypeptide and the RNA encoding it. The following are steps which may be performed in order to create the RNA display library of this Example: 1) in vitro translation of the library into RNAs; 2) DNA digestion to remove templates; 3) conjugation of a puromycin/psoralen-comprising oligo linker to the 3' end of the RNA molecules by hybridizing the oligo linker and UV crosslinking to form a stable 3' terminal hairpin structure (or alternatively using enzymatic splint- and Y-ligations); 4) in vitro translation/fusion formation by using rabbit reticulocyte lysate to translate the puromycin-linked RNAs and covalently link nascent polypeptides in the library to the RNA encoding it by the action of puromycin after the addition of $Mg^{2+}$ and $K^+$; 5) RNA and/or protein purification to isolate the RNA displayed library, such as by using oligo(dT) and/or anti-FLAG purification, 6) optional pre-selection step to eliminate library members with premature stop codons; and 7) reverse transcription generates a DNA/RNA hybrid to prevent the RNA genotypes from forming secondary structures which might inhibit later steps.

Selection steps are performed for target binding to an affinity tag purified, recombinantly expressed protein target, such as, e.g., human cell surface protein overexpressed on tumor and/or cancer cells. The purified target is obtained or generated. The purified target is biotinylated using Lightning-Link® Biotin kit (Innova Bioscience, Cambridge, U.K.). The target biomolecule is immobilized on microbeads and the beads packed into a column.

The RNA-displayed library generated above is diluted in 50 mM Tris-HCl, pH 7.5, 150 mM NaCl, 0.05% Tween-20, 1 mg/mL bovine serum albumin (BSA), 5 mM 2-mercaptoethanol, and 0.5 mM $CaCl_2$. In addition, selection steps are performed in the presence of tRNA and BSA to reduce nonspecific polypeptide interactions. The RNA-displayed library is flowed over the column and washed extensively. Bound library members are eluted, PCR performed to amplify the genotype, and the PCR products are sequenced to identify the genotype of selected fusion polypeptides.

Example 9. Ribosome Display Screening a Non-Ribotoxic Library Comprising a Saporin Ribotoxic Region A polynucleotide construct is created or obtained which encodes a saporin ribotoxic region which is catalytically inactivated via one or more mutations (see e.g. SEQ ID NOs: 33-35). Alternatively, a polynucleotide construct is created or obtained which encodes a ribotoxic, saporin ribotoxic region (such as, e.g, comprising the amino acid sequence of SEQ ID NO:10; see also recombinant saporins created by Flavell D et al., *Br J Cancer* 84: 571-8 (2001); Polito L et al., *Toxins* 3: 697-720 (2011)). Then one or more alterations are made to the polynucleotide to create a reduced ribotoxicity and/or non-ribotoxic variant(s). For example, alterations that result in the polynucleotide construct encoding a saporin ribotoxic region variant with one or more of the following amino acid residue substitutions at the natively positioned amino acid residue(s): E176K and/or R179Q.

The polynucleotide construct is designed not to encode a polypeptide which comprises any functional cell binding region from a native saporin toxin. This reduced ribotoxicity and/or non-ribotoxic saporin encoding polynucleotide construct is used as a template nucleic acid for generating protein display expression libraries of the invention encoding fusion polypeptides comprising modified saporin ribotoxic regions and binding regions.

The binding regions are derived from a large antibody repertoire of over $1 \times 10^{11}$ members derived from a naïve chordate immune cell library. The library is transcribed to generate mRNA using the Ribomax Large Scale Production System (T7) (Promega, Madison, Wis., U.S.) and the mRNA purified using a ProbeQuant™ G50 micro column (Amersham Biosciences, Piscataway, N.J., U.S.). Following purification, the mRNA is translated in vitro using *E. coli* S30 extract in a buffer containing 50 mM Tris-acetate, pH 7.5, 200 mM potassium glutamate, 7 mM magnesium acetate, 90 µg/mL protein disulfide isomerase, 0.35 mM each amino acid, 2 mM ATP, 0.5 mM GTP, 1.0 mM cAMP, 30 mM acetylphosphate, 0.5 mg/mL *E. coli* tRNA, 20 µg/mL folinic acid, and 1.5% polyethylene glycol (PEG) molecular weight 8000. The reaction is stopped by placing the reaction at 0° C. and tertiary ribosome complexes are stabilized by addition of the buffer, either a 5-fold dilution of 50 mM Tris-acetate, pH7.5, 150 mM NaCl, 50 mM magnesium acetate, 0.1% Tween20, and 2.5 g/mL heparin (selection buffer) or PBS with 5 mmol/L $MgCl_2$ and 5% BSA.

Libraries are generally made with fusion proteins lacking stop codons necessary for release of nascent polypeptide during translation to create a population of ternary mRNA/ribosome/display polypeptide complexes.

The transcription of the library is performed with mMessage mMachine T7 Kit (Ambion, Austin, Tex., U.S.) using about 500 ng of template DNA. The resulting library of capped mRNAs is purified according to the manufacturer's instructions. Following purification, the mRNA is translated in vitro using rabbit reticulocyte lysate (nuclease treated) for 30 minutes at 30° C.

The purified mRNAs are briefly heated to dissolve secondary structures and added to the in vitro translation reaction mixture containing 70 mM KCl, 0.8 mM MgOAc, 20 µM amino acid mix, 40 units RNase inhibitor (Promega, Madison, Wis., U.S.) and 33 µL rabbit reticulocyte lysate (Promega, Madison, Wis., U.S.). The translation reaction is stopped by adding cold PBS with 0.1% (v/v) Tween 20® (Sigma-Aldrich, St. Louis, Mo., U.S.), 6.4 mM MgCl2, 2.5 mg/mL heparin to adjust the final Mg concentration to 5 mM.

Ribosome complexes are selected for binding affinity en masse from displayed polypeptide fusion-ribosome library using a biotinylated target biomolecule coating magnetic carboxylic acid microbeads. The target biomolecule is coupled to the beads using amine coupling according to the manufacturer's instructions (Dynabeads® MyOne Carboxylic Acid, Life Technologies, Grand Island, N.Y., U.S.). The coated beads are washed with PBS containing 0.1% (v/v) Tween 20® and 0.5% (w/v) BSA. Multiple rounds of subtractive biopanning and selection are performed in cold RNase-free buffer by combining the target coated beads with the displayed polypeptides fused to ribosomes/RNA complexes. Each selection round uses slow agitation for one hour followed by wash steps to remove unbound library complexes. Washes are performed with PBS 0.1% (v/v) Tween 20®, 5 mM $MgCl_2$, 2.5 mg/mL heparin, 5% (w/v) skim milk in DEPC $H_2O$. In later selection rounds, the stringency is increased by adding more washes steps with the same wash solution.

To finish the biopanning selection stage, the microbeads are washed and the genotypes of bound fusion polypeptides complexes are identified by reverse-transcription PCR (RT-PCR) and DNA sequencing. The mRNAs of the microbead bound ribosome complexes are released from the tertiary complexes by use of the EDTA buffer (50 mM Tris-acetate, pH 7.5, 150 mM NaCl, 20 mM EDTA, 10 µg/mL *S. cerevisiae* RNA). The positive hits' genotypes, the mRNAs, are purified using the High Pure RNA Isolation Kit (Roche Diagnostics, Mannheim, Germany) and reverse transcribed into cDNAs followed by PCR amplification and DNA sequencing.

Alternatively, scFv binding domains are synthesized on a programmable microarray and subjected to ribosome display and library enrichment. After creating the microarray, the DNA molecules of the library are released in water and subjected to PCR with primers containing restrict site ends. The PCR products are then cloned into an expression vector and $1 \times 10^6$ *E. coli* transformants generated. Plasmid DNA from the library is used as template for in vitro transcription (RiboMAX Large Scale RNA Production System T7, Promega, Madison, Wis., U.S.) to produce RNA which is then purified with TRI reagent (Ambion, Austin, Tex., U.S.). MagneGST beads (Promega, Madison, Wis., U.S.) are washed three times in 1×TBST. Then the beads are coated with target biomolecule with GST tag. Target and bead binding is performed overnight at 4° C. with agitation. Washes and binding is performed in RD Buffer plus 50 mM Mg acetate and 0.5% Tween 20 plus RNasin (Promega, Madison, Wis., U.S.). Beads are mixed with displayed ribosome library for hours. Beads and bead bound materials are collected by centrifugation at 14,000 g for 5 minutes at 4° C. and wash several times. After the final wash, the ribosomal complex by resuspending in the buffer with 20 mM EDTA and incubating for 10 minutes at 37° C. The RNA is then purified on Qiagen RNeasy columns and eluted with water. Reverse transcription and RNase H steps are used to create a cDNA library of enriched binder genotypes. PCR products are cloned into vectors for sequencing.

Example 10. Protein-DNA Linkage Display Screening a Non-Ribotoxic Library Comprising a Sarcin Ribotoxic Region A polynucleotide construct is created or obtained which encodes a sarcin ribotoxic region which is catalytically inactivated via one or more mutations (see e.g. SEQ ID NOs: 23-24). Alternatively, a polynucleotide construct is created or obtained which encodes a ribotoxic, sarcin ribotoxic region (such as, e.g, comprising the amino acid sequence of SEQ ID NO:7), and then one or more alterations are made to the polynucleotide to create a reduced ribotoxicity and/or non-ribotoxic variant(s). For example, alterations that result in the polynucleotide construct encoding a sarcin ribotoxic region variant with one or more of the following amino acid residue substitutions at the natively positioned amino acid residue(s): H137Q or H137A (see e.g. Carreras-Sangrá N et al., *Protein Eng Des Sel* 25: 425-35 (2012)). These amino acid residue substitutions and/or others at positions such as, e.g., at tryptophan-48, histidine-49, histidine-50, tryptophan-51, asparagine-54, isoleucine-69, glutamate-95, glutamate-96, lysine-11, lysine-112, lysine-114, arginine-121, histidine-136, may be selected to severely attenuate or eliminate sarcin enzymatic activity without significantly changing the overall structure of the sarcin ribotoxic region polypeptide.

A library of nucleic acids is created using the sarcin ribotoxic region construct to fuse to a nucleic acid encoding a bacterially displayed surface scaffold. In this example, a library of nucleic acids is generated which encode M.Hae II fusions to a sarcin ribotoxic region with a carboxy terminal binding region comprising a randomized polypeptide of 19-25 amino acid residues using methods known to the skilled worker.

An oil emulsion solution is prepared using 50% (v/v) mineral oil, 45% (v/v) Span 80, and 5% (v/v) Tween-80 (Sigma-Aldrich, St. Louis, Mo., U.S.). A mixed phase solution is made by mixing 50 µL water with 950 µL of the oil emulsion at 4° C. with vigorous stirring for at least 5 minutes. Water compartments of water-in-oil emulsions are created on a support layer such as multiwall plastic plate, silica wafer, or biochip optionally with a dispersion tool or with surfactants such as, e.g., perfluoro surfactants (see e.g. Matochko W et al., *Methods* 58: 18-27 (2012)). Using the emulsion, compartments may be formed as polydisperse emulsions or monodisperse droplets in a microfluidics channel (see Kaminski T et al., *Lab Chip* 12: 3995-4002 (2012)). The use of isolated compartments to generate library members minimizes amplification biases.

In vitro transcription and translation of the library is performed to create the displayed polypeptide from the DNA templates of the library. 50 ng of library template DNA is used for each emulsion droplet. The expressed polypeptides are covalently attached to the DNA molecules encoding them by forming adducts using the modified methylation target sequence 5'-GGFC-3' (F=5-fluoro-2'-deoxycytidine).

During transcription and translation in individual droplets, DNA template molecules (genotypes) at a concentration of about 2 nM are covalently cross-linked to expressed library polypeptides (phenotypes) by the presence of the recombinant M.Hae III in the expressed library fusion polypeptides. This process is allowed to proceed at 30° C. for at least three hours. Subsequently, the aqueous phase is extracted from the emulsion and the biotinylated DNA templates are captured on the surface of streptavidin coated magnetic beads (Dynabeads® M-280 Streptavidin, Life Technologies, Grand Island, N.Y., U.S.) according to the manufacturer's instructions. After several washes with water, bound DNA molecules are released from the beads by heating the samples for two minutes to 70° C. in the presence of an excess of short biotinylated, double-stranded DNA fragments.

After forming the DNA-linked displayed polypeptides in droplets, the emulsions are broken by centrifugation and combined into a single mixture with a breaking buffer (PBS or TBS with 1 millimolar (mM) CaCl2, pH 7.4) or Krytox® (see Matochko W et al., *Methods* 58: 18-27 (2012)). The mixture is ether extracted to obtain the aqueous phase comprising the DNA-linked displayed fusion polypeptides.

Then selection steps are performed on the library, such as binding affinity positive and negative selections in buffered solutions such as PBS, TBS, TE, or derivatives thereof. Blocking nonspecific binding is accomplished using incubation for 15 minutes at room temperature with biotinylated short double stranded DNA molecules: 5'-biotin-GGA GCT TCT GCA TTC TGT GTG CTG-3' (SEQ ID NO:88) (Qiagen); final concentration 125 µM. After positive selection for binding, the unbound materials are washed away and the bound DNA-linked displayed polypeptides are identified by PCR.

Selection steps are performed for target binding to an affinity tag purified, recombinantly expressed protein target, such as, e.g., human cell surface protein overexpressed on tumor and/or cancer cells. Purified target biomolecules are obtained or generated. Purified target is biotinylated using Lightning-Link® Biotin kit (Innova Bioscience, Cambridge, UK). The target biomolecule is linked to magnetic streptavidin microbeads (Dynabeads® M-280 Streptavidin, Life Technologies, Grand Island, N.Y., U.S.) according to the manufacturer's instructions. Selections for binding the target are performed in solution using an automated KingFisher™ magnetic bead system (Thermo Lab Systems, Thermo Scientific, Waltham, Mass., U.S.).

Positive selection steps are performed on the target biomolecule coated microbeads. The target biomolecule combined with the DNA-linked expressed fusion polypeptide library is incubated on a rotary shaker at 120 r.p.m. for 60-90 minutes. Washes are performed with 80 µL TE-buffer (10 mM Tris, 1 mM EDTA, pH=7.5). The magnetic beads are washed six times with 100 µL TBSCT, followed by one wash with 100 µL TBSC using KingFisher™ Flex Magnetic Particle Separator (Thermo Scientific, Waltham, Mass., U.S.). A KOH elution step is performed at the end to prepare the captured "hits" for PCR using 6 mM KOH solution pH 11.7. The samples are neutralized prior to adding a portion to a PCR mixture for DNA template sequence identification.

Example 11. Cell Surface Display Screening a Non-Ribotoxic Library Comprising a Ricin Ribotoxic Region A polynucleotide construct is created or obtained which encodes a ricin toxin (RT) ribotoxic region which is catalytically inactivated via one or more mutations (see e.g. SEQ ID NOs: 20-22). Alternatively, a polynucleotide construct is created or obtained which encodes a ribotoxic, ricin ribotoxic region (such as, e.g, comprising the amino acid sequence of SEQ ID NO:6 or described in Lui X et al., *MAbs* 4: 57-68 (2012), and then one or more alterations are made to the polynucleotide to create a reduced ribotoxicity and/or non-ribotoxic variant(s). For example, alterations that result in the polynucleotide construct encoding a ricin ribotoxic region variant with one or more of the following amino acid residue substitutions at the natively positioned amino acid residue(s): Y80S, E177Q, R180H, S203N, and/or R213N but which may optionally comprise one or more deletions as described by Munishkin A, Wool I, *J Biol Chem* 270: 30581-7 (1995). These amino acid residue substitutions and/or others at positions such as, e.g., at arginine-48, asparagine-122, tyrosine-123, asparagine-209, tryptophan-211, glycine-212, serine-215, and isoleucine-252, may be selected to severely attenuate or eliminate DT enzymatic activity without significantly changing the overall structure of the DT ribotoxic region polypeptide.

The polynucleotide construct is designed not to encode a polypeptide which comprises any functional cell binding region from a native ricin toxin. In addition, the ricin construct may optionally comprise modifications to natively positioned amino acid residues, such as, e.g., the substitution N97A (see Lui X et al., *MAbs* 4: 57-68 (2012)).

A library of the antibody alternative scaffold Fn3 is obtained or generated that has varying loop lengths comprising an amino acid residue repertoire similar to that of an immunoglobulin CDR-H3 (Hackel B et al., *J Mol Biol* 40: 84-96 (2010)).

A construct is created based on a pCT-CON vector, pCT201, or pCT302 which encodes Aga2p fused to the ricin ribotoxic region fused to a binding region. The Aga2p protein naturally forms two disulfide bonds with the cell wall protein Aga1p thereby providing cell surface display of the fusion protein. The binding region is diversified by previous manipulations and/or mutagenesis in the final construct such as by error-prone PCR focused on the three loop areas (BC, DE, FG loops), error-prone PCR for the entire Fn3 gene to introduce framework mutations, and DNA shuffling of the loops.

The affinity binding selection assay requires the preparation of magnetic microbeads coated with the target biomolecule. First, the target biomolecule is biotinylated. Then 7-35 pmol of biotinylated target per 10 mL of Dynabeads® ($4\times10^5$ beads/mL) in 100 mL of PBSA (1 phosphate-buffered saline, 0.1% bovine serum albumin) in microcentrifuge tubes. The tubes are incubated at 4° C. with agitation for at least 1 hour. Finally, the beads are washed with the 1 mL of PBSA and isolated just prior to applying the yeast library of displayed fusion polypeptides.

The EBY100 yeast strain is used and grown on tryptophan deficient media. Protein display is triggered by inducing expression of the construct by switching the transformed yeast from a glucose-rich medium to a galactose-rich medium. Selections are performed using target biomolecule coated magnetic microbeads prepared as described herein and/or using methods known to the skilled worker (see e.g. Ackerman M et al., *Biotechnol Prog* 25: 774-83 (2009)).

Then library screening is performed using Dynabeads® Biotin Binder (Life Technologies, Grand Island, N.Y., U.S.). First the library is depleted of non-specific binders and then enriched for binders to biotinylated target biomolecules of interest by incubating them with agitation at 4° C. for 2 hours. Using a magnet, separate the unbound yeast cells to a new tube and wash with PBSA.

After two rounds of magnetic bead enrichment, the Fn3 sublibrary is subjected to mutagenesis to introduce diversity into the population. This new library is screened again using magnetic beads. The selection process of the Fn3 binders remains the same with two rounds of enrichment followed by mutagenesis. Multiple rounds of negative and positive selection are performed with increasing wash stringency. Increasing the selection stringency helps to minimize undesired fast-amplifying clones which lack the selected-for phenotype. Other selection steps may include yeast display immunoprecipitation methods (see e.g. Cho Y et al., *J Immunol Methods* 341: 117-26 (2009)). More complicated selections may be performed to select for binding to mammalian cells (see e.g. Wang X, Shusta E, *J Immunol Methods* 304: 30-42 (2005); Wang X et al., *Nat Methods* 4: 143-5 (2007); Krishnaswamy S et al., *Anal Biochem* 395: 16-24 (2009)).

Individual yeast clones are isolated and their pCT-CON vector are purified for sequencing using the Zymoprep™ Yeast Plasmid Miniprep II (Zymo Research Corp., Irvine, Calif., U.S.). Sequencing of the insert region of the pCT-CON provides for identification of the polynucleotide sequence which encodes yeast surface displayed fusion polypeptide screening hits.

Example 12. Phage Display Screening a Ribotoxic Library Comprising a Shiga Toxin Ribotoxic Region in the Presence of the RIP Inhibitor 4-APP A phagemid scFv display library is created using a vector with lox sites in a coding region encoding a linker between $V_H$ and $V_L$ regions using methods known in the art. This allows for Cre recombinase based binding region shuffling to create millions of diverse clones. Total RNA is prepared from an immunized chordate or human samples. One or more cDNA libraries are created by using synthesized using random hexamers and reverse transcriptase of the total RNA using standard protocols known to the skilled worker. For example, different primers to different Ig coding regions may be selected, such as for IgM $V_H$ and IgM $V_L$ genes. Then $V_H$ and $V_L$ coding regions are reamplified to add a region of overlap in the scFv linker as well as restriction sites to facilitate restriction cloning steps. Next, scFv are assembled by ligating mixtures of equimolar amounts of $V_H$ and $V_L$ PCR products. The scFv libraries may be cloned into a primary library which is later used to create a larger and more diverse secondary library.

The phagemid library is transformed into BS1365 host cells expressing Cre recombinase to cause recombination between the $V_H$ and $V_L$ coding regions. To link genotype to phenotype, the phagemid must be amplified and then isolated for individual infection of *E. coli*.

A library is created to display scFvs on the surface of bacteriophage using an optimized human framework and mutagenic oligonucleotides designed to create diversity in the heavy chain variable determining regions as well as the third light chain variable determining region. The mutagenic oligonucleotides are synthesized using a custom trimer phosphoramidite mix (Glen Research, Sterling Va., U.S.) containing codons for nine amino acids in the following molar ratios: 25% of Tyr, 20% of Ser, 20% of Gly, 10% of Ala and 5% each of Phe, Trp, His, Pro and Val. The library is created with each scFv associated with a Shiga toxin ribotoxic region comprising only wild-type Shiga toxin amino acid sequences.

Phages are produced in the presence of 1 mM the Shiga toxin ribotoxic region inhibitor 4-APP by superinfection of *E. coli* with the KM13 helper phage, which contains a trypsin recognition site between domain D2 and D3 of phage protein III. Phages are titrated by counting colony forming units (CFU) from a dilution series.

Phage selection is performed in the presence of 1 mM the Shiga toxin ribotoxic region inhibitor 4-APP in 96-well Maxisorp® Immunoplates (Nunc, Rochester, N.Y., U.S.) for multiple rounds. Then individual phage clones are propagated in 96-well plates in the presence of 1 mM of the Ship toxin ribotoxic region inhibitor 4-APP and tested with ELISAs to characterize binding affinity. All ELISA confirmed binders are sequenced to identify the displayed polypeptide sequence.

The biomolecular target is prepared with a biotin tag. First, a recombinant form of the biomolecular target is obtained or generated and purified. Then the EZ-LinkH™ Sulfo-NHS-LC-LC-Biotin kit (Pierce, Thermo Scientific, Waltham, Mass., U.S.) is used to attach a biotin tag to the target according to the manufacturer's instructions.

Biopanning is performed in solution in the presence of 1 mM the Shiga toxin ribotoxic region inhibitor 4-APP using automation via the Kingfisher™ magnetic bead system (Thermo Lab Systems, Thermo Scientific, Waltham, Mass., U.S.). A pool of $1 \times 10^{14}$ colony forming units (cfu) of scFv phage library are incubated in PBS with 2% BSA, 0.01% Tween-20 (PBS-LT), and 1 mM of the Shiga toxin ribotoxic region inhibitor 4-APP at room temperature for one hour in a final volume of 125 mL to block non-specific binding. In the first selection round, 2.0 mg of biotinylated target molecules is incubated with the blocked scFv library at room temperature for 1 h, in a final volume of 150 mL. Following the incubation, the scFv phage-F1 complexes are incubated at room temperature for 15 minutes to allow phage binding onto $1\times10^{8}$ magnetic streptavidin microbeads (Dynabeads® M-280 Streptavidin, Life Technologies, Grand Island, N.Y., U.S.).

The bead complex is washed several times with PBS-LT and then PBS with 0.1% Tween-20 (PBS-T). The final scFv-toxin fusion displayed phage binding population is eluted via incubation at room temperature for 3 minutes and 30 seconds using 0.1 M glycine pH 22, and neutralized to pH 7.5 by the addition of 1 M Tris-HCl (pH 8.8). The eluted scFv phage population is recovered by infecting DH5aF' *E. coli* grown to an optical density 600 nm (OD600) of 0.5 at 37° C. for 45 minutes in the presence 1 mM of the Ship toxin ribotoxic region inhibitor 4-APP. The phage-infected bacterial cells are plated onto 2×YT medium agar containing 100 mg/mL carbenicillin, 3% glucose (2×YT/Carb/Glu), and 1 mM of the Shiga toxin ribotoxic region inhibitor 4-APP and incubated overnight at 30° C. The phage-infected bacterial cells are recovered in 1.8 mL of 2×YT/Carb/Glu broth containing 4-APP, 10 mL of the bacterial suspension is inoculated into 10 mL of 2×YT/Carb/Glu broth containing 4-APP and incubated with shaking (260 rpm) at 37° C. until the OD600 is about 0.5. Amplification is accomplished by co-infected the infected bacteria with approximately $1\times10^{13}$ cfu of M13K07 helper phage (Amersham Pharmacia Biotech Inc., Piscataway N.J., U.S.) by static incubation for 30 minutes at 37° C. Following co-infection, the infected bacteria are recovered by centrifugation at 3000 rpm for 30 minutes and re-suspended in 10 mL of 2×YT medium broth containing 100 mg/mL carbenicillin, 25 mg/mL kanamycin, and 1 mM of the Shiga toxin ribotoxic region inhibitor 4-APP and incubated overnight at 30° C. with shaking (260 rpm). Phage displaying fusion polypeptides are recovered by centrifugation at 3000 rpm for 30 minutes, isolation of the supernatant, and precipitation using PEG/NaCl (20% w/v polyethylene glycol 6000, 2.5 M NaCl).

Selection steps are performed on the phage displayed fusion polypeptides. The target biomolecule is immobilized in MaxiSorp® immunotubes (Thermo Lab Systems, Thermo Scientific, Waltham, Mass., U.S.) by coating them overnight with 200 µg of recombinant target biomolecule with a biotinylated tag and then washed three times with PBS and blocked with 2% milk/PBS at 37° C. for two hours. Phage displaying fusion polypeptides are incubated in the target containing immunotubes in 2% milk/PBS and 1 mM of the Shiga toxin ribotoxic region inhibitor 4-APP for at least one hour prior, and then the tubes are washed with PBS/0.1% Tween-20 with 4-APP. The stringency of the selection conditions is increased through multiple rounds of biopanning by decreasing the concentration of biotinylated target molecules by 10 fold and by increasing the wash time by 5 minutes each round. For each round, bound phage are eluted using 1 ml 100 mM triethylamine (pH 10), and neutralized by adding 0.5 ml 1 M Tris-HCl (pH 7.4) or using trypsin. The eluted phages are infected into 10 mL of exponentially growing TG1 cells in the presence of 1 mM of the Shiga toxin ribotoxic region inhibitor 4-APP, and the infected cells are selected for by using the appropriate media with 4-APP and/or antibiotics.

Identification of positive binders is accomplished by cloning out eluted phage. Bacterial cultures are infected with eluted phage for 30 minutes at 37° C., centrifuged at 3300 g for 10 minutes, resuspended, and spread onto antibiotic-resistant 2×YT agar plates with 4-APP. The resulting bacterial colonies on the plates are scraped into 2×YT medium with 1% glucose/ampicillin and 4-APP and grown to OD 0.5 prior to infection with about $1\times10^{9}$ M13K07 helper phage for amplification. The culture was incubated at 37° C. in 2×YT medium with ampicillin (100 g/mL), kanamycin (25 g/mL), and 4-APP but without glucose.

Each phage clone is tested for binding the target biomolecule using ELISA. The polypeptide sequence is identified by PCR amplification of the targeting region encoding DNA and/or the entire insert, purification of the PCR product, and DNA sequencing. The selected-for displayed fusion polypeptide amino acid sequences are deduced from the DNA sequences encoding them.

The phage library is screened for target cell binding and cellular internalization using human tumor cells. First, a negative selection step is used to deplete the library of undesired phages using control cells related to the cell type used for positive selection but lacking the cell surface target. Two to six rounds of preabsorption to these controls cells in the presence of the Shiga toxin ribotoxic region inhibitor 4-APP are used to deplete the library of unwanted phenotypes. Next, positive selection in the presence of the Shiga toxin ribotoxic region inhibitor 4-APP is performed on a target cell type, such as cells sorted by fluorescence-activated cell sorting (FACS) to ensure the presence of a desired cell surface target.

The target human tumor cells are cultured in T75 flasks in the presence of the Shiga toxin ribotoxic region inhibitor 4-APP for 72 hours or until 80-90% confluence. Most of the culture medium is removed from the cells. Phage displaying fusion polypeptides are selected for binding the cells by adding phage, such as, e.g., 1 mL of $1\times10^{3}$ phage diluted in 3 mL of culture media at 4° C. to the cells. The phage are incubated with the cells for two hours at 4° C. with occasional rocking. Next, the cells are incubated for 30 minutes at 37° C. in a 5% carbon dioxide gassed incubator to allow for cellular internalization of phage to occur. The cells are washed three times with 10 mL of PBS with 4-APP at 4° C. to remove unbound phage and then washed three times with 4 mL stripping buffer (50 mM glycine pH 2.8, 0.5 M NaCl, 2M urea, 2% polyvinylpyrrolidone) for 5 minutes to remove uninternalized phage. The stripping buffer is neutralized and the cells resuspended in culture medium with 1 mM 4-APP. The cells are treated with trypsin/EDTA (Gibcom TE) at 37° C. to detach the cells from the flask.

The cells are collected by centrifugation and lysed with 100 mM triethylamine (TEA) solution. The lysed cell mixture is neutralized and added to exponentially growing *E. coli* TG1 (OD600 nm of 0.5) at 37° C. Dilutions of phage are plated on thermophiles vitamin-mineral medium (TYE/tet) plates with the appropriate, selection antibiotic and with 4-APP, and then the plates are incubated overnight at 30° C. to propagate the phage selected for tumor cell internalization. The entire selection process is repeated at least one more time with identical conditions.

Deep sequencing of libraries before and after rounds of selections may be used to monitor library diversity such as by using a sequencing platform, e.g. 454 (Illumina, Roche, Solexa, Illumina HiSeq 2000, Illumina GAllx, Solid 5500xl, Illumina HiSeq 2500 Rapid Run, Ion torrent, 454 FLX titanium XL, PacBio RS II), or Polonator systems (see, Sims D et al., *Nat Rev Genet* 15: 121-32 (2014), for review).

Example 13. RNA Display Screening a Ribotoxic Library Comprising a PE Ribotoxic Region in the Presence of the Cholix Toxin Inhibitor PJ34

A polynucleotide construct is created or obtained which encodes a *Pseudomonas* exotoxin A (PE) derived ribotoxic region (such as, e.g, comprising the amino acid sequence of SEQ ID NO:8). The encoded PE ribotoxic region has both the amino- and carboxy termini from native PE truncated away to produce a smaller-sized region; however, the native furin cleavage site is maintained and/or an exogenous protease site is added (see e.g., PE constructs with truncations of all but 395-613 (see e.g. EP 2570425A2) or comprising only the PE III domain (see e.g. WO2012154530), and other variants (see e.g. Hwang J et al., *Cell* 48: 129-36 (1987); Kondo T et al., *J Biol Chem* 263: 9470-5 (1988); Pai L et al., *Proc Natl Acad Sci USA* 88: 3358-62 (1991); U.S. Pat. Nos. 4,892,827 and 5,602,095).

Optionally, the PE construct encodes a PE ribotoxic region with one or more internal deletions, such as, e.g., deletions of the Ia domain, deletions of various amino acid residues in the domains Ib, II and III; various deletions within domain II to reduce immunogenicity (see e.g. US 2010/0215656A1). Optionally, the PE construct encodes a PE ribotoxic region with various modifications/substitutions within the native amino acid residue positions 6-8, 28-30 or 289-291 (see e.g. US 2009/0010966A1); such as adding a nuclear localization signal motif (see e.g. US2014/0005362A1); various deletions of regions sensitive to lysosomal proteases (see e.g. Weldon J et al., *Blood* 13: 3792-3800 (2009); WO 2009/032954); and/or the addition of amino acids at the carboxy terminus which comprise a ER retention/retrieval signal motif (see e.g. Siegall C et al., *J Biol Chem* 264: 14256-61 (1989)). Optionally, the PE construct encodes a PE ribotoxic region with various amino acid substitutions to reduce immunogenicity, such as, e.g., substitutions of the native amino acid residue positions D406, R432, R467, R490, R513, E548, K590, Q592, and/or many others known in the art (see e.g. Chaudhary V et al., *J Biol Chem* 265: 16306-10 (1990); Brinkmann U et al., *Proc Natl Acad Sci USA* 89: 3065-9 (1992); Kasturi S et al., *J Biol Chem* 267: 23427-33 (1992); Benhar I et al., *J Biol Chem* 269: 13398-404 (1994); Kuan C et al., *J Biol Chem* 269: 7610-6 (1994); Onda M et al., *Proc Natl Acad Sci USA* 105: 11311-6 (2008); Liu, W et al., *Protein Eng Des Sel* 25: 1-6 (2012); WO 2011032022; WO 2012170617; WO 2007016150A2; EP 191040781; US 2009/0142341A1; US 2012/0263674A1; US 2013/0121983A1; US 2014/0094417A1; US 2014/0213529A1).

The polynucleotide construct is designed not to encode a polypeptide which comprises any functional, cell-binding region from a native PE toxin. For example, the entire PE domain Ia may be deleted (see e.g. U.S. Pat. No. 4,892,827) or alternatively mutated so as to be non-functional (see e.g. U.S. Pat. No. 5,512,658).

In this example, the binding regions are immunoglobulin-type polypeptides derived from a naïve repertoire of chordate immune cells. The polynucleotides constructing a binding region library are from a synthetically diversified IgNAR V domain library originating from a single starting IgNAR V domain isolated from a fish, immune cell derived library. The CDR3 loop sequence is randomly varied in sequence and length. A library of DNA cassettes are prepared by splice-overlap polymerase chain reaction (PCR). The amplified cassette fragments are gel purified, digested with the restriction endonucleases, and ligated into similarly digested phagemid display vector pHEN2. The resulting phagemids are cloned into *E. coli* using standard techniques known to the skilled worker.

These IgNAR V domain encoding polynucleotides are fused to the polynucleotides encoding the PE ribotoxic region to create a diverse nucleic acid library with each member designed to have the following sequences (from 5' to 3'): a T7 RNA polymerase promoter, a TMV translation enhancer, a IgNAR V domain, binding region, coding sequence, a PE ribotoxic region coding sequence, an amino-terminal FLAG tag coding sequence, and sequences designed for hybridizing with a puromycin-containing oligo linker. The binding region is specifically oriented amino-terminal to the ribotoxic region. Then, a linker is directionally ligated to the nucleic acids of the expression library members to create a library with $1\times10^{10}$ unique members or more.

RNA display is accomplished by forming a peptide bond within the ribosome between the last amino acid residue of each nascent polypeptide and the RNA encoding it. The following are steps which may be performed in order to create the RNA display library of this Example: 1) in vitro translation of the library into RNAs; 2) DNA digestion to remove templates; 3) conjugation of a puromycin/psoralen-comprising oligo linker to the 3' end of the RNA molecules by hybridizing the oligo linker and UV crosslinking to form a stable 3' terminal hairpin structure (or alternatively using enzymatic splint- and Y-ligations); 4) in vitro translation/fusion formation by using rabbit reticulocyte lysate to translate the puromycin-linked RNAs and covalently link nascent polypeptides in the library to the RNA encoding it by the action of puromycin after the addition of $Mg^{2+}$ and $K^+$; 5) RNA and/or protein purification to isolate the RNA displayed library, such as by using oligo-dT and/or anti-FLAG purification, 6) optional pre-selection step to eliminate library members with premature stop codons; and 7) reverse transcription generates a DNA/RNA hybrid to prevent the RNA genotypes from forming secondary structures which might inhibit later steps.

Selection steps are performed for target binding to an affinity tag purified, recombinantly expressed protein target, such as, e.g., human cell surface protein overexpressed on tumor and/or cancer cells. The purified target is obtained or generated. The purified target is biotinylated using Lightning-Link® Biotin kit (Innova Bioscience, Cambridge, U.K.). The target biomolecule is immobilized on microbeads and the beads packed into a column.

The RNA-displayed library generated above is diluted in 50 mM Tris-HCl, pH 7.5, 150 mM NaCl, 0.05% Tween-20, 1 mg/mL bovine serum albumin (BSA), 5 mM 2-mercaptoethanol, and 0.5 mM $CaCl_2$. In addition, selection steps are performed in the presence of tRNA and BSA to reduce nonspecific polypeptide interactions. The RNA-displayed library is flowed over the column and washed extensively. Bound library members are eluted, PCR performed to Example 14. Cell Surface Display Screening a Non-Ribotoxic Library Comprising a Restrictocin Ribotoxic Region in the Presence of a RNase Inhibitor A polynucleotide construct is created or obtained which encodes a restrictocin ribotoxic region which is catalytically inactivated via one or more mutations (see e.g. SEQ ID NO:63). Alternatively, a polynucleotide construct is created or obtained which encodes a ribotoxic, restrictocin ribotoxic region (such as, e.g, comprising the amino acid sequence of SEQ ID NO:13 or as described by Goyal A et al., Biochem J 345: 247-54 (2000)), and then one or more alterations are made to the polynucleotide to create a reduced ribotoxicity and/or non-ribotoxic variant(s). For example, alterations that result in the polynucleotide construct encoding a restrictocin ribotoxic region variant with one or more of the following amino acid residue substitutions at the natively positioned amino acid residue(s): Y47A, H49A, E95A, and/or H156A. These amino acid residue substitutions and/or others at positions such as, e.g., at such as, e.g., lysine-110, lysine-111, lysine-113, and/or arginine-120, may be selected to severely attenuate or eliminate restrictocin enzymatic activity without significantly changing the overall structure of the restrictocin ribotoxic region polypeptide.

The polynucleotide construct is designed not to encode a polypeptide which comprises any functional cell binding region from a native restrictocin toxin.

This reduced ribotoxicity and/or non-ribotoxic restrictocin polynucleotide construct is used as a template nucleic acid for generating protein display expression libraries of the invention encoding fusion polypeptides comprising modified restrictocin ribotoxic regions and binding regions.

In this example, the binding regions are immunoglobulin-type polypeptides derived from a biased repertoire of chordate immune cells. A camelid is immunized with purified target biomolecule (~1 microgram) mixed with veterinary vaccine adjuvant (GERBU). Blood samples are isolated from the immunized camelid to obtain lymphocytes. The lymphocytes are used to isolate total mRNAs. VHH genes are amplified from the isolated nucleic acids using RT-PCR of the mRNA using standard methods. The amplified $V_HH$ fragments are ligated into a vector designed for bacterial surface display in E. coli and a ribotoxic region encoding template in order to create a diverse nucleic acid library. The diversity can be increased beyond the scope of naturally occurring diversity using synthetic methods such as, e.g., in vitro evolution methods (see e.g. Barthelemy P et al., J Biol Chem 283: 3639-54 (2008)). The nucleic acid library is transformed into E. coli. In the presence of 25 µM CB5225540, expression of the diverse fusion polypeptides is induced such that the transformed E. coli display the fusion polypeptides on their surfaces. The induced E. coli cells (equivalent to a final OD600 of 5.0) are harvested by centrifugation (4000×g, 3 min), washed three times with 2 mL PBS (sterile filtered and degassed), and resuspended in a final volume of 1 mL of PBS.

The bacterial displayed polypeptides are selected for based on their binding to characteristics in solution to target biomolecule coated microbeads. Biotinylated purified recombinant target biomolecules at concentrations around 10 nM to 250 nM are added to 100 µL of induced bacteria in the presence of 25 µM CB5225540, the final volume was adjusted to 200 µL with "PBS-BSA" (PBS supplemented with 0.5% w/v BSA, sterile filtered and degassed also containing 25 µM CB5225540). The target biomolecule is incubated with the bacterial displayed fusion polypeptide library for one hour at room temperature. After incubation, the bacteria are washed three times with 1 mL of PBS-BSA, resuspended in 100 µL of the same buffer containing 20 µL of anti-biotin paramagnetic beads (Miltenyi Biotec) and incubated at 4° C. for 20 minutes. Next, bacteria are washed three times with 1 mL of PBS-BSA, resuspended in 500 µL of the same buffer, and applied onto a MACS MS column (Miltenyi Biotec), previously equilibrated with 500 µL of PBS-BSA and placed on an OctoMACS Separator (Miltenyi Biotec). The flow through of unbound bacteria is collected and the column is washed three times with 500 µL of PBS-BSA. The bound bacteria are eluted with 2 mL of bacterial liquid culture medium containing 25 µM CB5225540. The selections steps may be repeated if necessary. The bound bacteria are diluted and plated on medium containing 25 µM CB5225540 to isolate individual clones. After one or more binding selection, flow cytometry on individual clones is used to verify binding affinity. Positive hits are identified by sequencing plasmid DNA inserts from individual clones or by deep sequencing of pools of bound bacteria. Identified VHH domain polypeptides and protein may be produced as individual components or as cytotoxic fusion proteins using various methods known to the skilled worker, such as, e.g., as described by U.S. Pat. Nos. 6,838,254 and 7,794,981.

While certain embodiments of the invention have been described by way of illustration, it will be apparent that the invention may be put into practice with many modifications, variations and adaptations, and with the use of numerous equivalents or alternative solutions that are within the scope of persons skilled in the art, without departing from the spirit of the invention or exceeding the scope of the claims.

All publications, patents, and patent applications are herein incorporated by reference in their entirety to the same extent as if each individual publication, patent or patent application was specifically and individually indicated to be incorporated by reference in its entirety. The disclosures of U.S. provisional patent applications 61/777,130, 61/932,000, 61/936,255, 61/951,110, 61/951,121, 62/010,918, 62/049,325, and 62/107,644 are each incorporated herein by reference in its entirety. The disclosures of U.S. patent application publications US 2007/0298434 A1, US 2009/0156417 A1, and US 2013/0196928 A1 are each incorporated herein by reference in its entirety. The disclosures of international PCT patent application serial numbers WO 2014164693, WO 2014164680, WO 2015113005, and WO 2015113007 are each incorporated herein by reference in its entirety. The complete disclosure of all electronically available biological sequence information from GenBank (National Center for Biotechnology Information, U.S.) for amino acid and nucleotide sequences cited herein are incorporated by reference.

| Sequence Listing | | |
|---|---|---|
| ID Number | Text Description | Biological Sequence |
| SEQ ID NO: 1 | Shiga-like toxin 1 Subunit A (SLT-1A) | KEFTLDFSTAKTYVDSLNVIRSA IGTPLQTISSGGTSLLMIDSGSGD NLFAVDVRGIDPEEGRFNNLRLI VERNNLYVTGFVNRTNNVFYRF ADFSHVTFPGTTAVTLSGDSSYT TLQRVAGISRTGMQINRHSLTTS YLDLMSHSGTSLTQSVARAMLR FVTVTAEALRFRQIQRGFRTTLD DLSGRSYVMTAEDVDLTLNWG RLSSVLPDYHGQDSVRVGRISFG SINAILGSVALILNCHHASRVA RMASDEFPSMCPADGRVRGITH NKILWDSSTLGAILMRRTISS |
| SEQ ID NO: 2 | Shiga toxin Subunit A (StxA) | KEFTLDFSTAKTYVDSLNVIRSA IGTPLQTISSGGTSLLMIDSGTGD NLFAVDVRGIDPEEGRFNNLRLI VERNNLYVTGFVNRTNNVFYRF ADFSHVTFPGTTAVTLSGDSSYT TLQRVAGISRTGMQINRHSLTTS YLDLMSHSGTSLTQSVARAMLR FVTVTAEALRFRQIQRGFRTTLD DLSGRSYVMTAEDVDLTLNWG RLSSVLPDYHGQDSVRVGRISFG SINAILGSVALILNCHHASRVA RMASDEFPSMCPADGRVRGITH NKILWDSSTLGAILMRRTISS |
| SEQ ID NO: 3 | Shiga-like toxin 2 Subunit A (SLT-2A) | DEFTVDFSSQKSYVDSLNSIRSAI STPLGNISQGGVSVSVINHVLGG NYISLNVRGLDPYSERFNHLRLI MERNNLYVAGFINTETNIFYRFS DFSHISVPDVITVSMTTDSSYSSL QRIADLERTGMQIGRHSLVGSY LDLMEFRGRSMTRASSRAMLRF VTVIAEALRFRQIQRGFRPALSE ASPLYTMTAQDVDLTLNWGRIS NVLPEYRGEEGVRIGRISFNSLS AILGSVAVILNCHSTGSYSVRSV SQKQKTECQIVGDRAAIKVNNV LWEANTIAALLNRKPQDLTEPN Q |
| SEQ ID NO: 4 | Shiga toxin | NLYVTGFVNRTNNVFYRFADFS HVTFPGTTAVTLSGDSSYTTLQR VAGISRTGMQINRHSLTTSYLDL MSHSGTSLTQSVARAMLRFVTV TAEALRFRQIQRGFRTTLDDLSG RSYVMTAEDVDLTLNWGRLSS VLPDYHGQDSVRVGRISFGSINA ILGSVALIL |
| SEQ ID NO: 5 | DT | SSYHGTKPGYVDSIQKGIQKPKS GTQGNYDDDWKGFYSTDNKYD AAGYSVDNENPLSGKAGGVVK VTYPGLTKVLALKVDNAETIKK ELGLSLTEPLMEQVGTEEFIKRF GDGASRVVLSLPFAEGSSSVEYI NNWEQAKA |
| SEQ ID NO: 6 | ricin | FTTAGATVQSYTNFIRAVRGRLT TGADVRHEIPVLPNRVGLPINQR FILVELSNHAELSVTLALDVTNA YVVGYRAGNSAYFFHPDNQED AEAITHLFTDVQNRYTFAFGGN YDRLEQLAGNLRENIELGNGPL EEAISALYYSTGGTQLPTLARS FIICIQMISEAARFQYIEGEMRTRI RYNRRSAPDPSVITLENSWGRLS TAIQES |
| SEQ ID NO: 7 | sarcin | RLLYNQNKAESNSHHAPLSDGK TGSSYPHWFTNGYDGDGKLPK GRTPIKFGKSDCDRPPKHSKDG NGKTDHYLLEFPTFPDGHDYKF DSKKPKENPGPARVIYTYPNKV FCGIIAHTKENQGELKLCS |

-continued

| Sequence Listing | | |
|---|---|---|
| ID Number | Text Description | Biological Sequence |
| SEQ ID NO: 8 | PE | PEGGSLAALTAHQACHLPLETFT RHRQPRGWEQLEQCGYPVQRL VALYLAARLSWNQVDQVIRNA LASPGSGGDLGEAIREQPEQARL ALTLAAAESERFVRQGTGNDEA GAANGPADSGDALLERNYPTGA EFLGDGGDVSFSTRGTQNWTVE RLLQAHRQLEERGYVFVGYHGT FLEAAQSIVFGGVRARSQDLDAI WRGFYIAGDPALAYGYAQDQE PDARGRIRNGALLRVYVPRSSLP GFYRTSLTLAAPEAAGEVERLIG HPLPLRLDAITGPEEEGGRLETIL GWPLAERTVVIPSAIPTDPRNVG GDLDPSSIPDKEQAISALPDYAS QPGKPPREDLK |
| SEQ ID NO: 9 | gelonin | GLDTVSFSTKGATYITYVNFLNE LRVKLKPEGNSHGIPLLRKGDDP GKCFVLVALSNDNGQLAEIAID VTSVYVVGYQVRNRSYFFKDAP DAAYEGLFKNTIKNPLLFGGKT RLHFGGSYPSLEGEKAYRETTD LGIEPLRIGIKKLDENAIDNYKPT EIASSLLVVIQMVSEAARFTFIEN QIRNNFQQRIRPANNTISLENKW GKLSFQIRTSGANGMFSEAVELE RANGKKYYVTAVDQVKPKIAL LKFVDKDPE |
| SEQ ID NO: 10 | saporin | SITLDLVNPTAGQYSSFVDKIRN NVKDPNLKYGGTDIAVIGPPSKE KFLRINFQSSRGTVSLGLKRDNL YVVAYLAMDNTNVNRAYYFRS EITSAELTALFPEATTANQKALE YTEDYQSIEKNAQITQGDKSRKE LGLGIDLLLTFMEAVNKKARVV KNEARFLLIAIQMTAEVARFRYI QNLVTKNFPNKFDSDNKVIQFE VSWRKISTAI |
| SEQ ID NO: 11 | bryodin | DVSFRLSGATTTSYGVFIKNLRE ALPYERKVYNIPLLRSSISGSGR YTLLHLTNYADETISVAVDVTN VYIMGYLAGDVSYFFNEASATE AAKFVFKDAKKKVTLPYSGNYE RLQTAAGKIRENIPLGLPALDSAI TTLYYYTASSAASALLVLIQSTA ESARYKFIEQQIGKRVDKTFLPS LATISLENNWSALSKQIQIASTN NGQFESPVVLIDGNNQRVSITNA SARVVTSNIALLLNRNNIA |
| SEQ ID NO: 12 | Aspf1 | VAIKNLFLLAATAVSVLAAPSPL DARATWTCINQQLNPKTNKWE DKRLLYSQAKAESNSHHAPLSD GKTGSSYPHWFTNGYDGNGKLI KGRTPIKFGKADCDRPPKHSQN GMGKDDHYLLEFPTFPDGHDY KFDSKKPKEDPGPARVIYTYPN KVFCGIVAHQRGNQGDLRLCSH |
| SEQ ID NO: 13 | restrictocin | ATWTCINQQLNPKTNKWEDKR LLYSQAKAESNSHHAPLSDGKT GSSYPHWFTNGYDGNGKLIKGR TPIKFGKADCDRPPKHSQNGMG KDDHYLLEFPTFPDGHDYKFDS KKPKENPGPARVIYTYPNKVFC GIVAHQRGNQGDLRLCSH |
| SEQ ID NO: 14 | clavin | VAIKNLVLALTAVTALAMPSP LEERAATWTCMNEQKNPKTNK YENKRLLYNQNNAESNAHHAP LSDGKTGSSYPHWFTNGYDGD |

| ID Number | Text Description | Biological Sequence |
|---|---|---|
| | | GKILKGRTPIKWGNSDCDRPPK HSKNGDGKNDHYLLEFPTFPDG HQYNFDSKKPKEDPGPARVIYT YPNKVFCGIVAHTRENQGDLKL CSH |
| SEQ ID NO: 15 | Shiga toxin ribotoxic region polypeptide variant 1 | NLSVTGFVNRTNNVFYRFADFS HVTFPGTTAVTLSGDSSYTTLQR VAGISRTGMQINRHSLTTSYLDL MSHSGTSLTQSVARAMLRFVTV TADALRFRQIQRGFRTTLDDLSG RSYVMTAEDVDLTLNWGRLSS VLPDYHGQDSVRVGRISFGSINA ILGSVALIL |
| SEQ ID NO: 16 | Shiga toxin ribotoxic region polypeptide variant 2 | KEFTLDFSTAKTYVDSLNVIRSA IGTPLQTISSGGTSLLMIDSGSGD NLFAVDVRGIDPEEGRFNNLRLI VERNNLSVTGFVNRTNNVFYRF ADFSHVTFPGTTAVTLSGDSSYT TLQRVAGISRTGMQINRHSLTTS YLDLMSHSGTSLTQSVARAMLR FVTVTADALRFRQIQRGFRTTLD DLSGRSYVMTAEDVDLTLNWG RLSSVLPDYHGQDSVRVGRISFG SINAILGSVALILNCHHHASRVA R |
| SEQ ID NO: 17 | DT ribotoxic region polypeptide variant 1 | SSYHGTKPGYVDSIQKGIQKPKS GTQGNYDDDWKGFSSTDNKYD AAGYSVDNENPLSGKAGGVVK VTYPGLTKVLALKVDNAETIKK ELGLSLTEPLMEQVGTEEFIKRF GDGASRVVLSLPFAEGSSSVAYI NNWEQAKA |
| SEQ ID NO: 18 | DT ribotoxic region polypeptide variant 2 | GADDVVDSSKSFVMENFSSYHG TKPGYVDSIQKGIQKPKSGTQG NYDDDWKGFASTDNKYDAAG YSVDNENPLSGKAGGVVKVTYP GLTKVLALKVDNAETIKKELGL SLTEPLMEQVGTEEFIKRFGDGA SRVVLSLPFAEGSSSVAYINNWE QAKALSVELEINFETRGKRGQD AMYEYMAQACAGNRVRRSVGS SLSCINLDWDEIRDKTKTKIESL KEHGPIKNKMSESPNKTVSEEK AKQYLEEFHQTALEHPELSELKT VTGTNPVFAGANYAAWAVNVA QVIDSETADNLEKTTAALSILPGI GSVMGIADGAVHHNTEEIVAQS IALSSLMVAQAIPLVGELVDIGF AAYNFVESIINLFQVVHNSYNRP AYS |
| SEQ ID NO: 19 | DT ribotoxic region polypeptide variant 3 | GADDVVDSSKSFVMENFSSYHG TKPGYVDSIQKGIQKPKSGTQG NYDDDWKGFSSTDNKYDAAGY SVDNENPLSGKAGGVVKVTYPG LTKVLALKVDNAETIKKELGLS LTEPLMEQVGTEEFIKRFGDGAS RVVLSLPFAEGSSSVAYINNWE QAKALSVELEINFETRGKRGQD AMYEYMAQACAGNRVRRSVGS SLSCINLDWDVIRDKTKTKIESL KEHGPIKNKMSESPNKTVSEEK AKQYLEEFHQTALEHPELSELKT VTGTNPVFAGANYAAWAVNVA QVIDSETADNLEKTTAALSILPGI GSVMGIADGAVHHNTEEIVAQS IALSSLMVAQAIPLVGELVDIGF AAYNFVESIINLFQVVHNSYNRP AYSPGHKTQP |

-continued

| ID Number | Text Description | Biological Sequence |
|---|---|---|
| SEQ ID NO: 20 | ricin ribotoxic region polypeptide variant 1 | FTTAGATVQSYTNFIRAVRGRLT TGADVRHEIPVLPNRVGLPINQR FILVELSNHAELSVTLALDVTNA YVVGYRAGNSAYFFHPDNQED AEAITHLFTDVQNRYTFAFGGN SDRLEQLAGNLRENIELGNGPLE EAISALYYYSTGGTQLPTLARSFI ICIQMISDAARFQYIEGEMRTRIR YNRRSAPDPSVITLENSWGRLST AIQES |
| SEQ ID NO: 21 | ricin ribotoxic region polypeptide variant 2 | IFPKQYPIINFTTAGATVQSYTNF IRAVRGRLTTGADVRHEIPVLPN RVGLPINQRFILVELSNHAELSV TLALDVTNAYVVGYRAGNSAY FFHPDNQEDAEAITHLFTDVQN RYTFAFGGNADRLEQLAGNLRE NIELGNGPLEEAISALYYYSTGG TQLPTLARSFIICIQMISDAARFQ YIEGEMRTRIRYNRRSAPDPSVI TLENSWGRLSTAIQESNQGAFAS PIQLQRRNGSKFSVYDVSILIPIIA LMVYRCAPPPSSQF |
| SEQ ID NO: 22 | ricin ribotoxic region polypeptide variant 3 | VPKQYPIINFTTAGATVQSYTNFI RAVRGRLTTGADVRHEIPVLPN RVGLPINQRFILVELSNHAELSV TLALDVTNAYVVGYRAGNSAY FFHPDNQEDAEAITHLFTDVQN RYTFAFGGNSDRLEQLAGNLRE NIELGNGPLEEAISALYYYSTGG TQLPTLARSFIICIQMISAAARFQ YIEGEMRTRIRYNRRSAPDPSVI TLENSWGRLSTAIQESNQGAFAS PIQLQRRNGSKFSVYDVSILIPIIA LMVYRCAPPPSSQF |
| SEQ ID NO: 23 | sarcin ribotoxic region polypeptide variant 1 | RLLYNQNKAESNSHHAPLSDGK TGSSYPAWFTNGYDGDGKLPK GRTPIKFGKSDCDRPPKHSKDG NGKTDHYLLAFPTFPDGHDYKF DSKKPKENPGPARVIYTYPNKV FCGIIAHTKENQGELKLCS |
| SEQ ID NO: 24 | sarcin ribotoxic region polypeptide variant 2 | AVTWTCLNDQKNPKTNKYETK RLLYNQNKAESNSHHAPLSDGK TGSSYPAWFTNGYDGDGKLPK GRTPIKFGKSDCDRPPKHSKDG NGKTDHYLLAFPTFPDGHDYKF DSKKPKENPGPARVIYTYPNKV FCGIIAHTKENQGELKLCSH |
| SEQ ID NO: 25 | PE ribotoxic region polypeptide variant 1 | PEGGSLAALTAHQACHLPLETFT RHRQPRGWEQLEQCGYPVQRL VALYLAARLSWNQVDQVIRNA LASPGSGGDLGEAIREQPEQARL ALTLAAAESERFVRQGTGNDEA GAANGPADSGDALLERNYPTGA EFLGDGGDVSFSTRGTQNWTVE RLLQAHRQLEERGYVFVGYHGT FLEAAQSIVFGGVRARSQDLDAI WRGFYIAGDPALAYGYAQDQE PDARGRIRNGALLRVYVPRSSLP GFYRTSLTLAAPEAAGEVERLIG HPLPLRLDAITGPEEEGGALATIL GWPLAERTVVIPSAIPTDPRNVG GDLDPSSIPDKEQAISALPDYAS QPGKPPREDLK |
| SEQ ID NO: 26 | PE ribotoxic region polypeptide variant 2 | VLAGNPAKHDLDIKPTVISHRLH FPEGGSLAALTAHQACHLPLETF TRHRQPRGWEQLEQCGYPVQR LVALYLAARLSWNQVDQVIRN ALASPGSGGDLGEAIREQPEQAR LALTLAAAESERFVRQGTGNDE |

-continued

Sequence Listing

| ID Number | Text Description | Biological Sequence |
|---|---|---|
| | | AGAASADVVSLTCPVAAGECA<br>GPADSGDALLERNYPTGAEFLG<br>DGGDISFSTRGTQNWTVERLLQ<br>AHRQLEERGYVFVGYHGTFLEA<br>AQSIVFGGVRARSQDLDAIWRG<br>FYIAGDPALAYGYAQDQEPDAR<br>GRIRNGALLRVYVPRSSLPGFYR<br>TGLTLAAPEAAGEVERLIGHPLP<br>LRLDAITGPEEEGGALATILGWP<br>LAERTVVIPSAIPTDPRNVGGDL<br>DPSSIP |
| SEQ ID NO: 27 | PE ribotoxic region polypeptide variant 3 | AAAVVSHFNDCPDSHTQFCFHG<br>TCRFLVQEDKPACVCHSGYVGA<br>RCEHADLLAAMAEEGGSLAALT<br>AHQACHLPLETFTRHRQPRGWE<br>QLEQCGYPVQRLVALYLAARLS<br>WNQVDQVIRNALASPGSGGDL<br>GEAIREQPEQARLALTLAAAESE<br>RFVRQGTGNDEAGAANADVVS<br>LTCPVAAGECAGPADSGDALLE<br>RNYPTGAEFLGDGGDVSFSTRG<br>TQNWTVERLLQAHRQLEERGY<br>VFVGYHGTFLEAAQSIVFGGVR<br>ARSQDLDAIWRGFYIAGDPALA<br>YGYAQDQEPDARGRIRNGALLR<br>VYVPRSSLPGFYRTSLTLAAPEA<br>AGEVERLIGHPLPLRLDAITGPE<br>EEGGALATILGWPLAERTVVIPS<br>AIPTDPRNVGGDLDPSSIPDKEQ<br>AISALPDYASQPGKPPREDLK |
| SEQ ID NO: 28 | PE ribotoxic region polypeptide variant 4 | AAAVVSHFNDCPDSHTQFCFHG<br>TCRFLVQEDKPACVCHSGYVGA<br>RCEHADLLAAMAEEGGSLAALT<br>AHQAAHLPLETLTRHRQPRGWE<br>QLEQAGYPVQRLVALYLAARLS<br>WNQVDQVIRNALASPGSGGDL<br>GEAIREQPEQARLALTLAAAESE<br>RFVRQGTGNDEAGAANADVVS<br>LTCPVAAGECAGPADSGDALLE<br>RNYPTEAEFLGDGGDVSFSTRG<br>TQNWTVERLLQAHRQLEERGY<br>VFVGYHGTFLEAAQSIVFGGVR<br>ARSQDLDAIWRGFYIAGDPALA<br>YGYAQDQEPDARGRIRNGALLR<br>VYVPRSSLPGFYRTSLTLAAPEA<br>AGEVERLIGHPLPLRLDAITGPE<br>EEGGALATILGWPLAERTVVIPS<br>AIPTDPRNVGGDLDPSSIPDKEQ<br>AISALPDYASQPGKPPREDLK |
| SEQ ID NO: 29 | PE ribotoxic region polypeptide variant 5 | AAAVVSHFNDCPDSHTQFCFHG<br>TCRFLVQEDKPACVCHSGYVGA<br>RCEHADLLAAMAEEGGSLAALT<br>AHQACHLPLETFTRHRQPRGWE<br>QLEQCGYPVQRLVALYLAARLS<br>WNQVDQVIRNALASPGSGGDL<br>GEAIREQPEQARLALTLAAAESE<br>RFVRQGTGNDEAGAANADVVT<br>LTAPVAAGEAAGPADSGDALLE<br>RNYPTGAEFLGDGGDVSFSTRG<br>TQNWTVERLLQAHRQLEERGY<br>VFVGYHGTFLEAAQSIVFGGVR<br>ARSQDLDAIWRGFYIAGDPALA<br>YGYAQDQEPDARGRIRNGALLR<br>VYVPRSSLPGFYRTSLTLAAPEA<br>AGEVERLIGHPLPLRLDAITGPE<br>EEGGALATILGWPLAERTVVIPS<br>AIPTDPRNVGGDLDPSSIPDKEQ<br>AISALPDYASQPGKPPREDLK |
| SEQ ID NO: 30 | PE ribotoxic region polypeptide variant 6 (PE40) | AAAVVSHFNDCPDSHTQFCFHG<br>TCRFLVQEDKPACVCHSGYVGA<br>RCEHADLLAAMAEEGGSLAALT |

| ID Number | Text Description | Biological Sequence |
|---|---|---|
| | | AHQAAHLPLETLTRHRQPRGWE
QLEQAGYPVQRLVALYLAARLS
WNQVDQVIRNALASPGSGGDL
GEAIREQPEQARLALTLAAAESE
RFVRQGTGNDEAGAANADVVT
LTAPVAAGEAAGPADSGDALLE
RNYPTGAEFLGDGGDVSFSTRG
TQNWTVERLLQAHRQLEERGY
VFVGYHGTFLEAAQSIVFGGVR
ARSQDLDAIWRGFYIAGDPALA
YGYAQDQEPDARGRIRNGALLR
VYVPRSSLPGFYRTSLTLAAPEA
AGEVERLIGHPLPLRLDAITGPE
EEGGALATILGWPLAERTVVIPS
AIPTDPRNVGGDLDPSSIPDKEQ
AISALPDYASQPGKPPREDLK |
| SEQ ID NO: 31 | PE ribotoxic region polypeptide variant 7 | PEGGSLAALTAHQACHLPLETFT
RHRQPRGWEQLEQCGYPVQRL
VALYLAARLSWNQVDQVIRNA
LASPGSGGDLGEAIREQPEQARL
ALTLAAAESERFVRQGTGNDEA
GAANADVVSLTCPVAAGECAG
PADSGDALLERNYPTGAEFLGD
GGDVSFSTRGTQNWTVERLLQA
HRQLEERGYVFVGYHGTFLEAA
QSIVFGGVRARSQDLDAIWRGF
YIAGDPALAYGYAQDQEPDARG
RIRNGALLRVYVPRSSLPGFYRT
SLTLAAPEAAGEVERLIGHPLPL
RLDAITGPEEEGGALATILGWPL
AERTVVIPSAIPTDPRNVGGDLD
PSSIPDKEQAISALPDYASQPGKP
PKDEL |
| SEQ ID NO: 32 | gelonin ribotoxic region polypeptide | GLDTVSFSTKGATYITYVNFLNE
LRVKLKPEGNSHGIPLLRKGDDP
GKCFVLVALSNDNGQLAEIAID
VTSVAVVGYQVRNRSYFFKDAP
DAAYEGLFKNTIKNPLLFGGKT
RLHFGGSYPSLEGEKAYRETTD
LGIEPLRIGIKKLDENAIDNYKPT
EIASSLLVVIQMVSAAARFTFIEN
QIRNNFQQRIRPANNTISLENKW
GKLSFQIRTSGANGMFSEAVELE
RANGKKYYVTAVDQVKPKIAL
LKFVDKDPE |
| SEQ ID NO: 33 | saporin ribotoxic region polypeptide variant 1 | SITLDLVNPTAGQYSSFVDKIRN
NVKDPNLKYGGTDIAVIGPPSKE
KFLRINFQSSRGTVSLGLKRDNL
SVVAYLAMDNTNVNRAYYFRS
EITSAELTALFPEATTANQKALE
YTEDYQSIEKNAQITQGDKSRKE
LGLGIDLLLTFMEAVNKKARVV
KNEARFLLIAIQMTADVARFRYI
QNLVTKNFPNKFDSDNKVIQFE
VSWRKISTAI |
| SEQ ID NO: 34 | saporin ribotoxic region polypeptide variant 2 | KIYVVATIAWILLQFSAWTTTDA
VTSITLDLVNPTAGQYSSFVDKI
RNNVKDPNLKYGGTDIAVIGPPS
KDKFLRINFQSSRGTVSLGLKRD
NLAVVAYLAMDNTNVNRAYYF
KSEITSAELTALFPEATTANQKA
LEYTEDYQSIEKNAQITQGDKSR
KELGLGIDLLLTFMEAVNKKAR
VVKNEARFLLIAIQMTADVARF
RYIQNLVTKNFPNKFDSDNKVIQ
FEVSWRKISTAIYGDAKNGVFN
KDYDFGFGKVRQVKDLQMGLL
MYLGKPKSSNEANSTAYATTVL |
| SEQ ID NO: 35 | saporin ribotoxic region polypeptide variant 3 | VTSITLDLVNPTAGQYSSFVDKI
RNNVKDPNLKYGGTDIAVIGPPS |

Sequence Listing

| ID Number | Text Description | Biological Sequence |
|---|---|---|
| | | KEKFLRINFQSSRGTVSLGLKRD NLAVVAYLAMDNTNVNRAYYF RSEITSAELTALFPEATTANQKA LEYTEDYQSIEKNAQITQGDKSR KELGLGIDLLLTFMEAVNKKAR VVKNEARFLLIAIQMTAAVARF RYIQNLVTKNFPNKFDSDNKVIQ FEVSWRKISTAIYGDAKNGVFN KDYDFGFGKVRQVKDLQMGLL MYLGKPK |
| SEQ ID NO: 36 | bryodin ribotoxic region polypeptide | DVSFRLSGATTTSYGVFIKNLRE ALPYERKVYNIPLLRSSISGSGR YTLLHLTNYADETISVAVDVTN VAIMGYLAGDVSYFFNEASATE AAKFVFKDAKKKVTLPYSGNYE RLQTAAGKIRENIPLGLPALDSAI TTLYYYTASSAASALLVLIQSTA ASARYKFIEQQIGKRVDKTFLPS LATISLENNWSALSKQIQIASTN NGQFESPVVLIDGNNQRVSITNA SARVVTSNIALLLNRNNIA |
| SEQ ID NO: 37 | Aspfl ribotoxic region polypeptide | VAIKNLFLLAATAVSVLAAPSPL DARATWTCINQQLNPKTNKWE DKRLLYSQAKAESNSHHAPLSD GKTGSSYPAWFTNGYDGNGKLI KGRTPIKFGKADCDRPPKHSQN GMGKDDHYLLAFPTFPDGHDY KFDSKKPKEDPGPARVIYTYPN KVFCGIVAHQRGNQGDLRLCSH |
| SEQ ID NO: 38 | restrictocin ribotoxic region polypeptide | ATWTCINQQLNPKTNKWEDKR LLYSQAKAESNSHHAPLSDGKT GSSYPAWFTNGYDGNGKLIKGR TPIKFGKADCDRPPKHSQNGMG KDDHYLLAFPTFPDGHDYKFDS KKPKENPGPARVIYTYPNKVFC GIVAHQRGNQGDLRLCSH |
| SEQ ID NO: 39 | clavin ribotoxic region polypeptide | VAIKNLVLVALTAVTALAMPSP LEERAATWTCMNEQKNPKTNK YENKRLLYNQNNAESNAHHAP LSDGKTGSSYPAWFTNGYDGD GKILKGRTPIKWGNSDCDRPPK HSKNGDGKNDHYLLAFPTFPDG HQYNFDSKKPKEDPGPARVIYT YPNKVFCGIVAHTRENQGDLKL CSH |
| SEQ ID NO: 40 | Shiga toxin ribotoxic region polynucleotide variant 1 | aayytnwsngtnacnggnttygtnaaymgnac naayaaygtnttytaymgnttygcngayttyws ncaygtnacnttyccnggnacnacngcngtnac nytnwsnggngaywsnwsntayacnacnytn carmgngtngcnggnathwsnmgnacnggn atgcarathaaymgncaywsnytnacnacnw sntayytngayytnatgwsncaywsnggnacn wsnytnacncarwsngtngcnmgngcnatgy tnmgnttygtnacngtnacngcngaygcnytn mgnttymgncarathcarmgnggnttymgna cnacnytngaygayytnwsnggnmgnwsnt aygtnatgacngcngargaygtngayytnacny tnaaytggggnmgnytnwsnwsngtnytncc ngaytaycayggncargaywsngtnmgngtn ggnmgnathwsnttyggnwsnathaaygcna thytnggnwsngtngcnytnathytn |
| SEQ ID NO: 41 | Shiga toxin ribotoxic region polynucleotide variant 2 | aargarttyacnytngayttywsnacngcnaara cntaygtngaywsnytnaaygtnathmgnws ngcnathggnacnccnytncaracnathwsnw snggnggnacnwsnytnytnatgathgayws nggnwsnggngayaayytnttygcngtngay gtnmgnggnathgayccngargarggnmgnt tyaayaayytnmgnytnathgtngarmgnaay aayytnwsngtnacnggnttygtnaaymgnac |

| ID Number | Text Description | Biological Sequence |
|---|---|---|
| | | naayaaygtnttytaymgnttygcngayttyws<br>ncaygtnacnttyccnggnacnacngcngtnac<br>nytnwsnggngaywsnwsntayacnacnytn<br>carmgngtngcggnathwsnmgnacnggn<br>atgcarathaaymgncaywsnytnacnacnw<br>sntayytngayytnatgwsncaywsnggnacn<br>wsnytnacncarwsngtngcnmgngcnatgy<br>tnmgnttygtnacngtnacngcngaygcnytn<br>mgnttymgncarathcarmgnggnttymgna<br>cnacnytngaygayytnwsnggnmgnwsnt<br>aygtnatgacgcngargaygtngayytnacny<br>tnaaytggggnmgnytnwsnwsngtnytncc<br>ngaytaycayggncargaywsngtnmgngtn<br>ggnmgnathwsnttyggnwsnathaaygcna<br>thytnggnwsngtngcnytnathytnaaytgyc<br>aycaycaygcnwsnmgngtngcnmgn |
| SEQ ID NO: 42 | DT ribotoxic region polynucleotide variant 1 | wsnwsntaycayggnacnaarccnggntaygt<br>ngaywsnathcaraarggnathcaraarccnaa<br>rwsnggnacncaarggnaaytaygaygaygayt<br>ggaarggnttywsnwsnacngayaayaartay<br>gaygcngcnggntaywsngtngayaaygara<br>ayccnytnwsnggnaargcnggnggngtngt<br>naargtnacntayccnggnytnacnaargtnyt<br>ngcnytnaargtngayaaygcngaracnathaa<br>raargarytnggnytnwsnytnacngarccnyt<br>natggarcargtnggnacngargarttyathaar<br>mgnttyggngayggngcnwsnmgngtngtn<br>ytnwsnytnccnttygcngarggnwsnwsnw<br>sngtngcntayathaayaaytgggarcargcna<br>argcn |
| SEQ ID NO: 43 | DT ribotoxic region polynucleotide variant 2 | ggngcngaygaygtngtngaywsnwsnaar<br>wsnttygtnatggaraayttywsnwsntaycay<br>ggnacnaarccnggntaygtngaywsnathca<br>raarggnathcaraarccnaarwsnggnacnca<br>rggnaaytaygaygaygaytggaarggnttygc<br>nwsnacngayaayaartaygaygcngcnggnt<br>aywsngtngayaaygaraayccnytnwsngg<br>naargcnggnggngtngtnaargtnacntaycc<br>nggnytnacnaargtnytngcnytnaargtnga<br>yaaygcngaracnathaaraargarytnggnyt<br>nwsnytnacngarccnytnatggarcargtngg<br>nacngargarttyathaarmgnttyggngaygg<br>ngcnwsnmgngtngtnytnwsnytnccntty<br>gcngarggnwsnwsnwsngtngcntayatha<br>ayaaytgggarcargcnaargcnytnwsngtng<br>arytngarathaayttygaracnmgnggnaar<br>mgnggncargaygcnatgtaygartayatggc<br>ncargcntgygcnggnaaymgngtnmgnmg<br>nwsngtnggnwsnwsnytnwsntgyathaay<br>ytngaytgggaygarathmgngayaaracnaa<br>racnaarathgarwsnytnaargarcayggncc<br>nathaaraayaaratgwsngarwsnccnaaya<br>aracngtnwsngargaraargcnaarcartayyt<br>ngargarttycaycaracngcnytngarcayccn<br>garytnwsngarytnaaracngtnacnggnacn<br>aayccngtnttygcnggngcnaaytaygcngc<br>ntgggcngtnaaygtngcncargtnathgayws<br>ngaracngcngayaayytngaraaracnacng<br>cngcnytnwsnathytnccnggnathggnws<br>ngtnatgggnathgcngayggngcngtncayc<br>ayaaycngargarathgtngcncarwsnathg<br>cnytnwsnwsnytnatggtngcncargcnath<br>ccnytngtnggngarytngtngayathggntty<br>gcngcntayaayttygtngarwsnathathaay<br>ytnttycargtngtncayaaywsntayaaymgn<br>ccngcntaywsn |
| SEQ ID NO: 44 | DT ribotoxic region polynucleotide variant 3 | ggngcngaygaygtngtngaywsnwsnaar<br>wsnttygtnatggaraayttywsnwsntaycay<br>ggnacnaarccnggntaygtngaywsnathca<br>raarggnathcaraarccnaarwsnggnacnca<br>rggnaaytaygaygaygaytggaarggnttyw<br>snwsnacngayaayaartaygaygcngcngg |

| ID Number | Text Description | Biological Sequence |
|---|---|---|
| | | ntaywsngtngayaaygaraayccnytnwsng gnaargcnggnggngtngtnaargtnacntayc cnggnytnacnaargtnytngcnytnaargtng ayaaygcngaracnathaaraargarytnggny tnwsnytnacngarccnytnatggarcargtng gnacngargarttyathaarmgnttyggngayg gngcnwsnmgngtngtnytnwsnytnccntt ygcngarggnwsnwsnwsngtngcntayath aayaaytgggarcargcnaargcnytnwsngtn garytngarathaayttygaracnmgnggnaar mgnggncargaygcnatgtaygartayatggc ncargcntgygcnggnaaymgngtnmgnmg nwsngtnggnwsnwsnytnwsntgyathaay ytngaytgggaygtnathmgngayaaracnaa racnaarathgarwsnytnaargarcayggncc nathaaraayaaratgwsngarwsnccnaaya aracngtnwsngargaraargcnaarcartayyt ngargarttycaycaracngcnytngarcaycen garytnwsngarytnaaracngtnacnggnacn aayccngtnttygcnggngcnaaytaygcngc ntgggcngtnaaygtngcncargtnathgayws ngaracngcngayaayytngaraaracnacng cngcnytnwsnathytnccnggnathggnws ngtnatgggnathgcngayggngcngtncayc ayaayacngargarathgtngcncarwsnathg cnytnwsnwsnytnatggtngcncargcnath ccnytngtnggngarytngtngayathggntty gcngcntayaayttygtngarwsnathathaay ytnttycargtngtncayaaywsntayaaymgn ccngcntaywsnccnggncayaaracncarccn |
| SEQ ID NO: 45 | ricin ribotoxic region polynucleotide variant 1 | ttyacnacngcnggngcnacngtncarwsnta yacnaayttyathmgngcngtnmgnggnmg nytnacnacnggngcngaygtnmgncaygar athccngtnytnccnaaymgngtnggnytncc nathaaycarmgnttyathytngtngarytnws naaycaygcngarytnwsngtnacnytngcny tngaygtnacnaaygcntaygtngtnggntay mgngcnggnaaywsngcntayttyttycaycc ngayaacargargaygcngargcnathacnc ayytnttyacngaygtncaraaymgntayacnt tygcnttyggnggnaaywsngaymgnytnga rcarytngcnggnaayytnmgngaraayathg arytnggnaayggnccnytngargargcnath wsngcnytntaytaytayws nacnggnggnac ncarytnccnacnytngcnmgnwsnttyathat htgyathcaratgathwsngaygcngcnmgnt tycartayathgarggngaratgmgnacnmgn athmgntayaaymgnmgnwsngcnccnga yccnwsngtnathacnytngaraaywsntggg gnmgnytnwsnacngcnathcargarwsn |
| SEQ ID NO: 46 | ricin ribotoxic region polynucleotide variant 2 | athttyccnaarcartayccnathathaayttyac nacngcnggngcnacngtncarwsntayacna ayttyathmgngcngtnmgnggnmgnytna cnacnggngcngaygtnmgncaygarathcc ngtnytnccnaaymgngtnggnytnccnatha aycarmgnttyathytngtngarytnwsnaayc aygcngarytnwsngtnacnytngcnytngay gtnacnaaygcntaygtngtnggntaymgngc nggnaaywsngcntayttyttycayccngayaa ycargargaygcngargcnathacncayytntt yacngaygtncaraaymgntayacnttygctt yggnggnaaygcngaymgnytngarcarytn gcnggnaayytnmgngaraayathgarytngg naayggnccnytngargargcnathwsngcny tntaytaytaywsnacnggnggnacncarytnc cnacnytngcnmgnwsnttyathathtgyathc aratgathwsngaygcngcnmgnttycartaya thgarggngaratgmgnacnmgnathmgnta yaaymgnmgnwsngcnccngayccnwsng tnathacnytngaraaywsntggggnmgnytn wsnacngcnathcargarwsnaaycarggngc nttygcnwsnccnathcarytncarmgnmgn aayggnwsnaarttywsngtntaygaygtnws |

Sequence Listing

| ID Number | Text Description | Biological Sequence |
|---|---|---|
| | | nathytnathccnathathgcnytnatggtntay mgntgygcnccnccnccnwsnwsncartty |
| SEQ ID NO: 47 | ricin ribotoxic region polynucleotide variant 3 | gtnccnaarcartayccnathathaayttyacnac ngcnggngcnacngtncarwsntayacnaayt tyathmgngcngtnmgnggnmgnytnacna cnggngcngaygtnmgncaygarathccngt nytnccnaaymgngtnggnytnccnathaayc armgnttyathytngtngarytnwsnaaycayg cngarytnwsngtnacnytngcnytngaygtn acnaaygcntaygtngtnggntaymgngcng gnaaywsngcntayttyttycayccngayaayc argargaygcngargcnathacncayytnttyac ngaygtncaraaymgntayacnttygcnttygg nggnaaywsngaymgnytngarcarytngcn ggnaayytnmgngaraayathgarytnggnaa yggnccnytngargargcnathwsngcnytnt aytaytaywsnacnggnggnacncarytnccn acnytngcnmgnwsnttyathathtgyathcar atgathwsngcngcnmgnttycartayath garggngaratgmgnacnmgnathmgntaya aymgnmgnwsngcnccngayccnwsngtn athacnytngaraaywsntgggnmgnytnw snacngcnathcargarwsnaaycarggngcnt tygcnwsnccnathcarytncarmgnmgnaa yggnwsnaarttywsngtntaygaygtnwsna thytnathccnathathgcnytnatggtntaymg ntgygcnccnccnccnwsnwsncartty |
| SEQ ID NO: 48 | sarcin ribotoxic region polynucleotide variant 1 | mgnytnytntayaaycaraayaargcngarws naaywsncaycaygcnccnytnwsngaygg naaracnggnwsnwsntayccngcntggttya cnaayggntaygayggngayggnaarytnccn aarggnmgnacnccnathaarttyggnaarws ngaytgygaymgnccnccnaarcaywsnaar gayggnaayggnaaracngaycaytayytnyt ngcnttyccnacnttyccngayggncaygayta yaarttygaywsnaaraarccnaargaraayc nggnccngcnmgngtnathtayacntayccna ayaargtnttytgyggnathathgcncayacnaa rgaraaycarggngarytnaarytntgywsn |
| SEQ ID NO: 49 | sarcin ribotoxic region polynucleotide variant 2 | gcngtnacntggacntgyytnaaygaycaraar aayccnaaracnaayaartaygaracnaarmgn ytnytntayaaycaraayaargcngarwsnaay wsncaycaygcnccnytnwsngayggnaara cnggnwsnwsntayccngcntggttyacnaay ggntaygayggngayggnaarytnccnaargg nmgnacnccnathaarttyggnaarwsngayt gygaymgnccnccnaarcaywsnaargaygg naayggnaaracngaycaytayytnytngcntt yccnacnttyccngayggncaygaytayaartt ygaywsnaaraarccnaargaraayccnggnc cngcnmgngtnathtayacntayccnaayaar gtnttytgyggnathathgcncayacnaargara aycarggngarytnaarytntgywsncay |
| SEQ ID NO: 50 | PE ribotoxic region polynucleotide variant 1 | ccngarggnggnwsnytngcngcnytnacng cncaycargcntgycayytnccnytngaracntt yacnmgncaymgncarccnmgnggntggg arcarytngarcartgyggntayccngtncarm gnytngtngcnytntayytngcngcnmgnytn wsntggaaycargtngaycargtnathmgnaa ygcnytngcnwsnccnggnwsnggnggnga yytnggngargcnathmgngarcarccngarc argcnmgnytngcnytnacnytngcngcngc ngarwsngarmgnttygtnmgncarggnacn ggnaaygaygargcnggngcngcnaayggnc cngcngaywsnggngaygcnytnytngarm gnaaytayccnacnggngcngarttyytnggn gayggnggngaygtnwsnttywsnacnmgn ggnacncaraaytngacngtngarmgnytnyt ncargcnaymgncarytngargarmgnggn taygtnttygtnggntaycayggnacnttyytng argcngcncarwsnathgtnttyggnggngtn |

-continued

Sequence Listing

| ID Number | Text Description | Biological Sequence |
|---|---|---|
| | | mgngcnmgnwsncargayytngaygcnath<br>tggmgnggnttytayathgcnggngayccngc<br>nytngcntayggntaygcncargaycargarcc<br>ngaygcnmgnggnmgnathmgnaayggng<br>cnytnytnmgngtntaygtnccnmgnwsnw<br>snytnccnggnttytaymgnacnwsnytnacn<br>ytngcngcnccngargcngcnggngargtnga<br>rmgnytnathggncayccnytnccnytnmgn<br>ytngaygcnathacnggnccngargargargg<br>nggngcnytngcnacnathytnggntggccny<br>tngcngarmgnacngtngtnathccnwsngcn<br>athccnacngayccnmgnaaygtnggnggng<br>ayytngayccnwsnwsnathccngayaargar<br>cargcnathwsngcnytnccngaytaygcnws<br>ncarccnggnaarccnccnmgngargayytna<br>ar |
| SEQ ID NO: 51 | PE ribotoxic region polynucleotide variant 2 | gcngcngcngtngtnwsncayttyaaygaytg<br>yccngaywsncayacncarttytgyttycaygg<br>nacntgymgnttyytngtncargargayaarcc<br>ngcntgygtntgycaywsnggntaygtnggng<br>cnmgntgygarcaygcngayytnytngcngc<br>natggcngargarggnggnwsnytngcngcn<br>ytnacngcncaycargcntgycayytnccnytn<br>garacnttyacnmgncaymgncarccnmgn<br>ggntgggarcarytngarcartgyggntayccn<br>gtncarmgnytngtngcnytntayytngcngc<br>nmgnytnwsntggaaycargtngaycargtny<br>tngcnggnaayccngcnaarcaygayytngay<br>athaarccnacngtnathwsncaymgnytnca<br>yttyccngarggnggnwsnytngcngcnytna<br>cngcncaycargcntgycayytnccnytngara<br>cnttyacnmgncaymgncarccnmgnggnt<br>gggarcarytngarcartgyggntayccngtnca<br>rmgnytngtngcnytntayytngcngcnmgn<br>ytnwsntggaaycargtngaycargtnathmg<br>naaygcnytngcnwsnccnggnwsnggngg<br>ngayytnggngargcnathmgngarcarccng<br>arcargcnmgnytngcnytnacnytngcngcn<br>gcngarwsngarmgnttygtnmgncarggna<br>cnggnaaygaygargcnggngcngcnwsng<br>cngaygtngtnwsnytnacntgyccngtngcn<br>gcnggngartgygcnggnccngcngaywsng<br>gngaygcnytnytngarmgnaaytayccnacn<br>ggngcngarttyytnggngayggnggngayat<br>hwsnttywsnacnmgnggnacncaraaytgg<br>acngtngarmgnytnytncargcncaymgnc<br>arytngargarmgnggntaygtnttygtnggnt<br>aycayggnacnttyytngargcngcncarwsn<br>athgtnttyggnggngtnmgngcnmgnwsnc<br>argayytngaygcnathtggmgnggnttytaya<br>thgcnggngayccngcnytngcntayggntay<br>gcncargaycargarccngaygcnmgnggn<br>mgnathmgnaayggngcnytnytnmgngtn<br>taygtnccnmgnwsnwsnytnccnggnttyta<br>ymgnacnggnytnacnytngcngcnccngar<br>gcngcnggngargtngarmgnytnathggnca<br>yccnytnccnytnmgnytngaygcnathacng<br>gnccngargargarggnggngcnytngcnacn<br>athytnggntggccnytngcngarmgnacngt<br>ngtnathccnwsngcnathccnacngaycm<br>mgnaaygtnggnggngayytngayccnwsn<br>wsnathccn |
| SEQ ID NO: 52 | PE ribotoxic region polynucleotide variant 3 | gcngcngcngtngtnwsncayttyaaygaytg<br>yccngaywsncayacncarttytgyttycaygg<br>nacntgymgnttyytngtncargargayaarcc<br>ngcntgygtntgycaywsnggntaygtnggng<br>cnmgntgygarcaygcngayytnytngcngc<br>natggcngargarggnggnwsnytngcngcn<br>ytnacngcncaycargcntgycayytnccnytn<br>garacnttyacnmgncaymgncarccnmgn<br>ggntgggarcarytngarcartgyggntayccn<br>gtncarmgnytngtngcnytntayytngcngc<br>nmgnytnwsntggaaycargtngaycargtna |

-continued

Sequence Listing

| ID Number | Text Description | Biological Sequence |
| --- | --- | --- |
| | | thmgnaaygcnytngcnwsnccnggnwsng<br>gnggngayytnggngargcnathmgngarca<br>rccngarcargcnmgnytngcnytnacnytng<br>cngcngcngarwsngarmgnttygtnmgnca<br>rggnacnggnaaygaygargcnggngcngcn<br>aaygcngaygtngtnwsnytnacntgyccngt<br>ngcngcnggngartgygcnggnccngcngay<br>wsnggngaygcnytnytngarmgnaaytayc<br>cnacnggngcngarttyytnggngayggnggn<br>gaygtnwsnttywsnacnmgnggnacncara<br>aytggacngtngarmgnytnytncargcncay<br>mgncarytngargarmgnggntaygtnttygt<br>nggntaycayggnacnttyytngargcngcnca<br>rwsnathgtnttyggnggngtnmgngcnmgn<br>wsncargayytngaygcnathtggmgnggntt<br>ytayathgcnggngayccngcnytngcntayg<br>gntaygcncargaycargarccngaygcnmgn<br>ggnmgnathmgnaayggngcnytnytnmg<br>ngtntaygtnccnmgnwsnwsnytnccnggn<br>ttytaymgnacnwsnytnacnytngcngcncc<br>ngargcngcnggngargtngarmgnytnathg<br>gncayccnytnccnytnmgnytngaygcnath<br>acnggnccngargargarggnggngcnytngc<br>nacnathytnggntggccnytngcngarmgna<br>cngtngtnathccnwsngcnathccnacngay<br>ccnmgnaaygtnggnggngayytngayccn<br>wsnwsnathccngayaargarcargcnathws<br>ngcnytnccngaytaygcnwsncarccnggna<br>arccnccnmgngargayytnaar |
| SEQ ID NO: 53 | PE ribotoxic region polynucleotide variant 4 | gcngcngcngtngtnwsncayttyaaygaytg<br>yccngaywsncayacncarttytgyttycaygg<br>nacntgymgnttyytngtncargargayaarcc<br>ngcntgygtntgycaywsnggntaygtnggng<br>cnmgntgygarcaygcngayytnytngcngc<br>natggcngargarggnggnwsnytngcngcn<br>ytnacngcncaycargcntgycayytnccnytn<br>garacnttyacnmgncaymgncarccnmgn<br>ggntgggarcarytngarcartgyggntayccn<br>gtncarmgnytngtngcnytntayytngcngc<br>nmgnytnwsntggaaycargtngaycargcn<br>gcngcngtngtnwsncayttyaaygaytgycc<br>ngaywsncayacncarttytgyttycayggnac<br>ntgymgnttyytngtncargargayaarccngc<br>ntgygtntgycaywsnggntaygtnggngcn<br>mgntgygarcaygcngayytnytngcngcnat<br>ggcngargarggnggnwsnytngcngcnytn<br>acngcncaycargcngcncayytnccnytnga<br>racnytnacnmgncaymgncarccnmgngg<br>ntgggarcarytngarcargcnggntayccngtn<br>carmgnytngtngcnytntayytngcngcnm<br>gnytnwsntggaaycargtngaycargtnath<br>mgnaaygcnytngcnwsnccnggnwsngg<br>nggngayytnggngargcnathmgngarcarc<br>cngarcargcnmgnytngcnytnacnytngcn<br>gcngcngarwsngarmgnttygtnmgncarg<br>gnacnggnaaygaygargcnggngcngcnaa<br>ygcngaygtngtnwsnytnacntgyccngtng<br>cngcnggngartgygcnggnccngcngayws<br>nggngaygcnytnytngarmgnaaytayccn<br>acngargcngarttyytnggngayggnggnga<br>ygtnwsnttywsnacnmgnggnacncaraay<br>tggacngtngarmgnytnytncargcncaymg<br>ncarytngargarmgnggntaygtnttygtngg<br>ntaycayggnacnttyytngargcngcncarws<br>nathgtntty ggnggngtnmgngcnmgnws<br>ncargayytngaygcnathtggmgnggnttyta<br>yathgcnggngayccngcnytngcntayggnt<br>aygcncargaycargarccngaygcnmgngg<br>nmgnathmgnaayggngcnytnytnmgngt<br>ntaygtnccnmgnwsnwsnytnccnggnttyt<br>aymgnacnwsnytnacnytngcngcnccnga<br>rgcngcnggngargtngarmgnytnathggnc<br>ayccnytnccnytnmgnytngaygcnathacn<br>ggnccngargargarggnggngcnytngcnac |

| ID Number | Text Description | Biological Sequence |
|---|---|---|
| | | nathytnggntggccnytngcngarmgnacng tngtnathccnwsngcnathccnacngayccn mgnaaygtnggnggngayytngayccnwsn wsnathccngayaargarcargcnathwsngc nytnccngaytaygcnwsncarccnggnaarc cnccnmgngargayytnaar |
| SEQ ID NO: 54 | PE ribotoxic region polynucleotide variant 5 | gcngcngcngtngtnwsncayttyaaygaytg yccngaywsncayacncarttytgyttycaygg nacntgymgnttyytngtncargargayaarcc ngcntgygtntgycaywsnggntaygtnggng cnmgntgygarcaygcngayytnytngcngc natggcngargarggnggnwsnytngcngcn ytnacngcncaycargcntgycayytnccnytn garacnttyacnmgncaymgncarccnmgn ggntgggarcarytngarcartgyggntaycc gtncarmgnytgtngcnytntayytngcngc nmgnytnwsntggaaycargtngaycargtna thmgnaaygcnytngcnwsnccnggnwsng gnggngayytnggngargcnathmgngarca rccngarcargcnmgnytngcnytnacnytng cngcngcngarwsngarmgntty gtnmgnca rggnacnggnaaygaygargcnggngcngcn aaygcngaygtngtnacnytnacngcnccngt ngcngcnggngargcngcnggnccngcngay wsnggngaygcnytnytngarmgnaaytayc cnacnggngcngarttyytnggngayggnggn gaygtnwsnttywsnacnmgnggnacncara aytggacngtngarmgnytnytncargcncay mgncarytngargarmgnggntaygtnttygt nggntaycayggnacnttyytngargcngcnca rwsnathgtnttyggnggngtnmgngcnmgn wsncargayytngaygcnathtggmgnggntt ytayathgcnggngayccngcnytngcntayg gntaygcncargaycargarccngaygcnmgn ggnmgnathmgnaayggngcnytnytnmg ngtntaygtnccnmgnwsnwsnytnccnggn ttytaymgnacnwsnytnacnytngcngcncc ngargcngcnggngargtngarmgnytnathg gncayccnytnccnytnmgnytngaygcnath acnggnccngargargarggnggncnytngc nacnathytnggntggccnytngcngarmgna cngtngtnathccnwsngcnathccnacngay ccnmgnaaygtnggnggngayytngayccn wsnwsnathccngayaargarcargcnathws ngcnytnccngaytaygcnwsncarccnggna arccnccnmgngargayytnaar |
| SEQ ID NO: 55 | PE ribotoxic region polynucleotide variant 6 (PE40) | gcngcngcngtngtnwsncayttyaaygaytg yccngaywsncayacncarttytgyttycaygg nacntgymgnttyytngtncargargayaarcc ngcntgygtntgycaywsnggntaygtnggng cnmgntgygarcaygcngayytnytngcngc natggcngargarggnggnwsnytngcngcn ytnacngcncaycargcncayytnccnyt ngaracnytnacnmgncaymgncarccnmg nggntgggarcarytngarcargcnggntaycc ngtncarmgnytgtngcnytntayytngcng cnmgnytnwsntggaaycargtngaycargtn athmgnaaygcnytngcnwsnccnggnwsn ggnggngayytnggngargcnathmgngarc arccngarcargcnmgnytngcnytnacnytn gcngcngcngarwsngarmgnttygtnmgnc arggnacnggnaaygaygargcnggngcngc naaygcngaygtngtnacnytnacngcnccng tngcngcnggngargcngcnggnccngcnga ywsnggngaygcnytnytngarmgnaaytay ccnacnggngcngarttyytnggngayggngg ngaygtnwsnttywsnacnmgnggnacncar aaytggacngtngarmgnytnytncargcnca ymgncarytngargarmgnggntaygtnttyg tnggntaycayggnacnttyytngargcngcnc arwsnathgtnttyggnggngtnmgngcnmg nwsncargayytngaygcnathtggmgnggn ttytayathgcnggngayccngcnytngcntay |

| ID Number | Text Description | Biological Sequence |
|---|---|---|
| | | ggntaygcncargaycargarccngaygcnmg nggnmgnathmgnaayggngcnytnytnm gngtntaygtnccnmgnwsnwsnytnccngg nttytaymgnacnwsnytnacnytngcngcnc cngargcngcnggngargtngarmgnytnath ggncayccnytnccnytnmgnytngaygcnat hacnggnccngargargarggnggngcnytng cnacnathytnggntggccnytngcngarmgn acngtngtnathccnwsngcnathccnacnga yccnmgnaaygtnggnggngayytngayccn wsnwsnathccngayaargarcargcnathws ngcnytnccngaytaygcnwsncarccnggna arccnccnmgngargayytnaar |
| SEQ ID NO: 56 | PE ribotoxic region polynucleotide variant 7 | ccngarggnggnwsnytngcngcnytnacng cncaycargcntgycayytnccnytngaracntt yacnmgncaymgncarccnmgnggntggg arcarytngarcartgyggntayccngtncarm gnytngtngcnytntayytngcgcnmgnytn wsntggaaycargtngaycargtnathmgnaa ygcnytgcnwsnccnggnwsnggnggnga yytnggngargcnathmgngarcarccngarc argcnmgnytngcnytnacnytngcngcngc ngarwsngarmgnttygtnmgncarggnacn ggnaaygaygargcnggngcngcnaaygcng aygtngtnwsnytnacntgyccngtngcngcn ggngartgygcnggnccngcngaywsnggng aygcnytnytngarmgnaaytaymccnacnggn gcngarttyytnggngayggnggngaygtnws nttywsnacnmgnggnacncaraaytggacn gtngarmgnytnytncargcncaymgncaryt ngargarmgnggntaygtnttygtnggntayca yggnacnttyytngargcngcncarwsnathgt nttyggnggngtnmgngcnmgnwsncarga yytngaygcnathtggmgnggnttytayathgc nggngayccngcnytngcntayggntaygcnc argaycargarccngaygcnmgnggnmgnat hmgnaayggngcnytnytnmgngtntaygtn ccnmgnwsnwsnytnccnggnttytaymgn acnwsnytnacnytngcngcnccngargcngc nggngargtngarmgnytnathggncayccny tnccnytnmgnytngaygcnathacnggnccn gargargarggnggngcnytgcnacnathytn ggntggccnytngcngarmgnacngtngtnat hccnwsngcnathccnacngayccnmgnaa ygtnggnggngayytngayccnwsnwsnath ccngayaargarcargcnathwsngcnytncc ngaytaygcnwsncarccnggnaarccnccna argaygarytn |
| SEQ ID NO: 57 | gelonin ribotoxic region polynucleotide | ggnytngayacngtnwsnttywsnacnaargg ngcnacntayathacntaygtnaayttyytnaay garytnmgngtnaarytnaarccngarggnaay wsncayggnathccnytnytnmgnaarggng aygayccnggnaartgyttygtnytngtngcnyt nwsnaaygayaayggncarytngcngarathg cnathgaygtnacnwsngtngcngtngtnggn taycargtnmgnaaymgnwsntayttyttyaar gaygcnccngaygcngcntaygarggnytntt yaaraayacnathaaraayccnytnytnttyggn ggnaaracnmgnytncayttyggnggnwsnt ayccnwsnytngarggngaraargcntaymg ngaracnacngayytnggnathgarccnytnm gnathggnathaaraarytngaygaraaygcna thgayaaytayaarccnacngarathgcnwsn wsnytnytngtngtnathcaratggtnwsngcn gcngcnmgnttyacnttyathgaraaycarath mgnaayaayttycarcarmgnathmgnccng cnaayaayacnathwsnytngaraayaartggg gnaarytnwsnttycarathmgnacnwsnggn gcnaayggnatgttywsngargcngtngarytn garmgngcnaayggnaaraartaytaygtnac ngcngtngaycargtnaarccnaaratgcnyt nytnaarttygtngayaargayccngar |

Sequence Listing

| ID Number | Text Description | Biological Sequence |
|---|---|---|
| SEQ ID NO: 58 | saporin ribotoxic region polynucleotide variant 1 | wsnathacnytngayytngtnaayccnacngc nggncartaywsnwsnttygtngayaarathm gnaayaaygtnaargayccnaayytnaartayg gnggnacngayathgcngtnathggnccnccn wsnaargaraarttyytnmgnathaayttycar wsnwsnmgnggnacngtnwsnytnggnytn aarmgngayaayytnwsngtngtngcntayyt ngcnatggayaayacnaaygtnaaymgngcn taytayttymgnwsngarathacnwsngcnga rytnacngcnytnttyccngargcnacnacngc naaycaraargcnytngartayacngargaytay carwsnathgaraaraaygcncarathacncar ggngayaarwsnmgnaargarytnggnytng gnathgayytnytnytnacnttyatggargcngt naayaaraargcnmgngtngtnaaraaygarg cnmgnttyytnytnathgcnathcaratgacng cngaygtngcnmgnttymgntayathcaraay ytngtnacnaaraayttyccnaayaarttygayw sngayaayaargtnathcarttygargtnwsntg gmgnaarathwsnacngcnath |
| SEQ ID NO: 59 | saporin ribotoxic region polynucleotide variant 2 | aarathtaygtngtngcnacnathgcntggathy tnytncarttywsngcntggacnacnacngayg cngtnacnwsnathacnytngayytngtnaay ccnacngcnggncartaywsnwsnttygtnga yaarathmgnaayaaygtnaargayccnaayy tnaartayggnggnacngayathgcngtnathg gnccnccnwsnaargayaarttyytnmgnath aayttycarwsnwsnmgnggnacngtnwsn ytnggnytnaarmgngayaayytngcngtngt ngcntayytngcnatggayaayacnaaygtnaa ymgngcntaytayttyaarwsngarathacnw sncngarytnacngcnytnttyccngargcna cnacngcnaaycaraargcnytngartayacng argaytaycarwsnathgaraaraaygcncarat hacncarggngayaarwsnmgnaargarytn ggnytnggnathgayytnytnytnacnttyatg gargcngtnaayaaraargcnmgngtngtnaar aaygargcnmgnttyytnytnathgcnathcar atgacngcngaygtngcnmgnttymgntayat hcaraayytngtnacnaaraayttyccnaayaar ttygaywsngayaayaargtnathcarttygarg tnwsntggmgnaarathwsnacngcnathtay ggngaygcnaaraayggngtnttyaayaargay taygayttyggnttyggnaargtnmgncargtn aargayytncaratgggnytnytnatgtayytng gnaarccnaarwsnwsnaaygargcnaayws nacngcntaygcnacnacngtnytn |
| SEQ ID NO: 60 | saporin ribotoxic region polynucleotide variant 3 | gtnacnwsnathacnytngayytngtnaaycc nacngcnggncartaywsnwsnttygtngaya arathmgnaayaaygtnaargayccnaayytn aartayggnggnacngayathgcngtnathgg nccnccnwsnaargaraarttyytnmgnathaa yttycarwsnwsnmgnggnacngtnwsnytn ggnytnaarmgngayaayytngcngtngtngc ntayytngcnatggayaayacnaaygtnaaym gngcntaytayttymgnwsngarathacnwsn gcngarytnacngcnytnttyccngargcnacn acngcnaaycaraargcnytngartayacngar gaytaycarwsnathgaraaraaygcncarath acncarggngayaarwsnmgnaargarytng gnytnggnathgayytnytnytnacnttyatgga rgcngtnaayaaraargcnmgngtngtnaaraa ygargcnmgnttyytnytnathgcnathcarat gacngcngcngtngcnmgnttymgntayath |

Sequence Listing

| ID Number | Text Description | Biological Sequence |
|---|---|---|
| | | caraayytngtnacnaaraayttyccnaayaartt<br>ygaywsngayaayaargtnathcarttygargt<br>nwsntggmgnaarathwsnacngcnathtay<br>ggngaygcnaaraayggngtnttyaayaargay<br>taygayttyggnttyggnaargtnmgncargtn<br>aargayytncaratgggnytnytnatgtayytng<br>gnaarccnaar |
| SEQ ID NO: 61 | bryodin ribotoxic region polynucleotide | gaygtnwsnttymgntnwsnggngcnacna<br>cnacnwsntayggngtnttyathaaraayytnm<br>gngargcnytnccntaygarmgnaargtntaya<br>ayathccnytnytnmgnwsnwsnathwsng<br>gnwsnggnmgntayacnytnytncayytnac<br>naaytaygcngaygaracnathwsngtngcng<br>tngaygtnacnaaygragcnathatgggntayy<br>tngcnggngaygtnwsntayttyttyaaygarg<br>cnwsngcnacngargcngcnaarttygtnttya<br>argaygcnaaraaraargtnacnytnccntayw<br>snggnaaytaygarmgnytncaracngcngcn<br>ggnaarathmgngaraayathccnytnggnyt<br>nccngcnytngaywsngcnathacnacnytnt<br>aytaytayacngcnwsnwsngcngcnwsngc<br>nytnytngtnytnathcarwsnacngcngcnw<br>sngcnmgntayaarttyathgarcarcarathgg<br>naarmgngtngayaaracnttyytnccnwsny<br>tngcnacnathwsnytngaraayaaytggwsn<br>gcnytnwsnaarcarathcarathgcnwsnacn<br>aayaayggncarttygarwsnccngtngtnytn<br>athgayggnaayaaycarmgngtnwsnatha<br>cnaaygcnwsngcnmgngtngtnacnwsna<br>ayathgcnytnytnytnaaymgnaayaayath<br>gcn |
| SEQ ID NO: 62 | Aspfl ribotoxic region polynucleotide | gtngcnathaaraayytnttyytnytngcngcna<br>cngcngtnwsngtnytngcngcnccnwsncc<br>nytngaygcnmgngcnacntggacntgyatha<br>aycarcarytnaayccnaaracnaayaartggga<br>rgayaarmgnytnytntaywsncargcnaarg<br>cngarwsnaaywsncaycaygcnccnytnws<br>ngayggnaaracnggnwsnwsntayccngcn<br>tggttyacnaayggntaygayggnaayggnaar<br>ytnathaarggnmgnacnccnathaarttyggn<br>aargcngaytgygaymgnccnccnaarcayw<br>sncaraayggnatgggnaargaygaycaytay<br>ytnytngcnttyccnacnttyccngayggncay<br>gaytayaarttygaywsnaaraarccnaargarg<br>ayccnggnccngcnmgngtnathtayacntay<br>ccnaayaargtnttytgyggnathgtngcncayc<br>armgnggnaaycarggngayytnmgnytntg<br>ywsncay |
| SEQ ID NO: 63 | restrictocin ribotoxic region polynucleotide | gcnacntggacntgyathaaycarcarytnaay<br>ccnaaracnaayaartgggargayaarmgnytn<br>ytntaywsncargcnaargcngarwsnaayws<br>ncaycaygcnccnytnwsngayggnaaracn<br>ggnwsnwsntayccngcntggttyacnaaygg<br>ntaygayggnaayggnaarytnathaarggnm<br>gnacnccnathaarttyggnaargcngaytgyg<br>aymgnccnccnaarcaywsncaraayggnat<br>gggnaargaygaycaytayytnytngcnttycc<br>nacnttyccngayggncaygaytayaarttyga<br>ywsnaaraarccnaargaraayccnggnccng<br>cnmgngtnathtayacntayccnaayaargtntt<br>ytgyggnathgtngcncaycarmgnggnaay<br>carggngayytnmgnytntgywsncay |
| SEQ ID NO: 64 | clavin ribotoxic region polynucleotide | gtngcnathaaraayytngtnytngtngcnytna<br>cngcngtnacngcnytngcnatgccnwsnccn<br>ytngargarmgngcngcnacntggacntgyat<br>gaaygarcaraaraayccnaaracnaayaartay<br>garaayaarmgnytnytntayaaycaraayaay<br>gcngarwsnaaygcncaycaygcnccnytnw<br>sngayggnaaracnggnwsnwsntayccngc<br>ntggttyacnaayggntaygayggngayggna<br>arathytnaarggnmgnacnccnathaartggg |

```
                              Sequence Listing
ID Number      Text Description           Biological Sequence
                                          gnaaywsngaytgygaymgnccnccnaarca
                                          ywsnaaraayggngayggnaaraaygaycayt
                                          ayytnytngcnttyccnacnttyccngayggnc
                                          aycartayaayttygaywsnaaraarccnaarga
                                          rgayccnggnccngcnmgngtnathtayacnt
                                          ayccnaayaargtnttytgyggnathgtngcnca
                                          yacnmgngaraaycarggngayytnaarytnt
                                          gywsncay
```

SEQUENCE LISTING (64 sequences)

SEQ ID NO: 1 - protein, 293 aa, Escherichia coli
  source: /note="Shiga-like toxin 1 Subunit A (SLT-1A)"
KEFTLDFSTAKTYVDSLNVIRSAIGTPLQTISSGGTSLLMIDSGSGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVARMASDEFPSMCPADGRVRGITHNKILWDSSTLGAILMRRTISS

SEQ ID NO: 2 - protein, 293 aa, Shigella dysenteriae
  source: /note="Shiga toxin Subunit A (StxA)"
KEFTLDFSTAKTYVDSLNVIRSAIGTPLQTISSGGTSLLMIDSGTGDNLFAVDVRGIDPEEGRFNNLRLIVERNNLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALILNCHHHASRVARMASDEFPSMCPADGRVRGITHNKILWDSSTLGAILMRRTISS

SEQ ID NO: 3 - protein, 297 aa, Escherichia coli
  source: /note="Shiga-like toxin 2 Subunit A (SLT-2A)"
DEFTVDFSSQKSYVDSLNSIRSAISTPLGNISQGGVSVSVINHVLGGNYISLNVRGLDPYSERFNHLRLIMERNNLYVAGFINTETNIFYRFSDFSHISVPDVITVSMTTDSSYSSLQRIADLERTGMQIGRHSLVGSYLDLMEFRGRSMTRASSRAMLRFVTVIAEALRFRQIQRGFRPALSEASPLYTMTAQDVDLTLNWGRISNVLPEYRGEEGVRIGRISFNSLSAILGSVAVILNCHSTGSYSVRSVSQKQKTECQIVGDRAAIKVNNVLWEANTIAALLNRKPQDLTEPNQ

SEQ ID NO: 4 - protein, 166 aa, Escherichia coli
  source: /note="Shiga toxin"
NLYVTGFVNRTNNVFYRFADFSHVTFPGTTAVTLSGDSSYTTLQRVAGISRTGMQINRHSLTTSYLDLMSHSGTSLTQSVARAMLRFVTVTAEALRFRQIQRGFRTTLDDLSGRSYVMTAEDVDLTLNWGRLSSVLPDYHGQDSVRVGRISFGSINAILGSVALIL

SEQ ID NO: 5 - protein, 141 aa, Corynebacterium diphtheriae
  source: /note="DT"
SSYHGTKPGYVDSIQKGIQKPKSGTQGNYDDDWKGFYSTDNKYDAAGYSVDNENPLSGKAGGVVKVTYPGLTKVLALKVDNAETIKKELGLSLTEPLMEQVGTEEFIKRFGDGASRVVLSLPFAEGSSSVEYINNWEQAKA

SEQ ID NO: 6 - protein, 211 aa, Ricinus communis
  source: /note="ricin"
FTTAGATVQSYTNFIRAVRGRLTTGADVRHEIPVLPNRVGLPINQRFILVELSNHAELSVTLALDVTNAYVVGYRAGNSAYFFHPDNQEDAEAITHLFTDVQNRYTFAFGGNYDRLEQLAGNLRENIELGNGPLEEAISALYYYSTGGTQLPTLARSFIICIQMISEAARFQYIEGEMRTRIRYNRRSAPDPSVITLENSWGRLSTAIQES

SEQ ID NO: 7 - protein, 128 aa, Aspergillus giganteus
  source: /note="sarcin"
RLLYNQNKAESNSHHAPLSDGKTGSSYPHWFTNGYDGDGKLPKGRTPIKFGKSDCDRPPKHSKDGNGKTDHYLLEFPTFPDGHDYKFDSKKPKENPGPARVIYTYPNKVFCGIIAHTKENQGELKLCS

SEQ ID NO: 8 - protein, 347 aa, Pseudomonas aeruginosa
  source: /note="PE"
PEGGSLAALTAHQACHLPLETFTRHRQPRGWEQLEQCGYPVQRLVALYLAARLSWNQVDQVIRNALASPGSGGDLGEAIREQPEQARLALTLAAAESERFVRQGTGNDEAGAANGPADSGDALLERNYPTGAEFLGDGGDVSFSTRGTQNWTVERLLQAHRQLEERGYVFVGYHGTFLEAAQSIVFGGVRARSQDLDAIWRGFYIAGDPALAYGYAQDQEPDARGRIRNGALLRVYVPRSSLPGFYRTSLTLAAPEAAGEVERLIGHPLPLRLDAITGPEEEGGRLETILGWPLAERTVVIPSAIPTDPRNVGGDLDPSSIPDKEQAISALPDYASQPGKPPREDLK

SEQ ID NO: 9 - protein, 258 aa, Gelonium multiflorum
  source: /note="gelonin"
GLDTVSFSTKGATYITYVNFLNELRVKLKPEGNSHGIPLLRKGDDPGKCFVLVALSNDNGQLAEIAIDVTSVYVVGYQVRNRSYFFKDAPDAAYEGLFKNTIKNPLLFGGKTRLHFGGSYPSLEGEKAYRETTDLGIEPLRIGIKKLDENAIDNYKPTEIASSLLVVIQMVSEAARFTFIENQIRNNFQQRIRPANNTISLENKWGKLSFQIRTSGANGMFSEAVELERANGKKYYVTAVDQVKPKIALLKFVDKDPE

SEQ ID NO: 10 - protein, 213 aa, Saponaria officinalis
  source: /note="saporin"
SITLDLVNPTAGQYSSFVDKIRNNVKDPNLKYGGTDIAVIGPPSKEKFLRINFQSSRGTVSLGLKRDNLYVVAYLAMDNTNVNRAYYFRSEITSAELTALFPEATTANQKALEYTEDYQSIEKNAQITQGDKSRKELGLGIDLLLTFMEAVNKKARVVKNEARFLLIAIQMTAEVARFRYIQNLVTKNFPNKFDSDNKVIQFEVSWRKISTAI

SEQ ID NO: 11 - protein, 247 aa, Bryonia sp.
  source: /note="bryodin"
DVSFRLSGATTTSYGVFIKNLREALPYERKVYNIPLLRSSISGSGRYTLLHLTNYADETISVAVDVTNVYIMGYLAGDVSYFFNEASATEAAKFVFKDAKKKVTLPYSGNYERLQTAAGKIRENIPLGLPALDSAITTLYYYTASSAASALLVLIQSTAESARYKFIEQQIGKRVDKTFLPSLATISLENNWSALSKQIQIASTNNGQFESPVVLIDGNNQRVSITNASARVVTSNIALLLNRNNIA

SEQ ID NO: 12 - protein, 175 aa, Aspergillus fumigatus
  source: /note="Aspf1"
VAIKNLFLLAATAVSVLAAPSPLDARATWTCINQQLNPKTNKWEDKRLLYSQAKAESNSHHAPLSDGKTGSSYPHWFTNGYDGNGKLIKGRTPIKFGKADCDRPPKHSQNGMGKDDHYLLEFPTFPDGHDYKFDSKKPKEDPGPARVIYTYPNKVFCGIVAHQRGNQGDLRLCSH

SEQ ID NO: 13 - protein, 149 aa, Aspergillus restrictus
  source: /note="restrictocin"
ATWTCINQQLNPKTNKWEDKRLLYSQAKAESNSHHAPLSDGKTGSSYPHWFTNGYDGNGKLIKGRTPIKFGKADCDRPPKHSQNGMGKDDHYLLEFPTFPDGHDYKFDSKKPKENPGPARVIYTYPNKVFCGIVAHQRGNQGDLRLCSH

SEQ ID NO: 14 - protein, 176 aa, Aspergillus clavatus
  source: /note="clavin"
VAIKNLVLVALTAVTALAMPSPLEERAATWTCMNEQKNPKTNKYENKRLLYNQNNAESNAHHAPLSDGKTGSSYPHWFTNGYDGDGKILKGRTPIKWGNSDCDRPPKHSKNGDGKNDHYLLEFPTFPDGHQYNFDSKKPKEDPGPARVIYTYPNKVFCGIVAHTRENQGDLKLCSH

SEQ ID NO: 15 - protein, 166 aa, Artificial Sequence
  source: /note="Description of Artificial Sequence: Synthetic polypeptide"
  source: /note="Shiga toxin ribotoxic region polypeptide variant 1"
NLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALIL

SEQ ID NO: 16 - protein, 251 aa, Artificial Sequence
  source: /note="Description of Artificial Sequence: Synthetic polypeptide"
  source: /note="Shiga toxin ribotoxic region polypeptide variant 2"
KEFTLDFSTAKTYVDSLNVIRSAIGTPLQTISSGGTSLLMIDSGSGDNLFAVDVRGIDPEEGRFNNLRLIVERNNLSVTGFVNRTNNVFYRFADFSHVTFPGTTAVTLSGDSSYTTLQRVAGISRTGMQINRHSLTTSYLDLMSHSGTSLTQSVARAMLRFVTVTADALRFRQIQRGFRTTLDDLSGRSYVMTAEDVDLTLNWGRLSSVLPDYHGQDSVRVGRISFGSINAILGSVALILNCHHHASRVAR

SEQ ID NO: 17 - protein, 141 aa, Artificial Sequence
  source: /note="Description of Artificial Sequence: Synthetic polypeptide"
  source: /note="DT ribotoxic region polypeptide variant 1"
SSYHGTKPGYVDSIQKGIQKPKSGTQGNYDDDWKGFSSTDNKYDAAGYSVDNENPLSGKAGGVVKVTYPGLTKVLALKVDNAETIKKELGLSLTEPLMEQVGTEEFIKRFGDGASRVVLSLPFAEGSSSVAYINNWEQAKA

SEQ ID NO: 18 - protein, 381 aa, Artificial Sequence
  source: /note="Description of Artificial Sequence: Synthetic polypeptide"
  source: /note="DT ribotoxic region polypeptide variant 2"
GADDVVDSSKSFVMENFSSYHGTKPGYVDSIQKGIQKPKSGTQGNYDDDWKGFASTDNKYDAAGYSVDNENPLSGKAGGVVKVTYPGLTKVLALKVDNAETIKKELGLSLTEPLMEQVGTEEFIKRFGDGASRVVLSLPFAEGSSSVAYINNWEQAKALSVELEINFETRGKRGQDAMYEYMAQACAGNRVRRSVGSSLSCINLDWDEIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYS

SEQ ID NO: 19 - protein, 388 aa, Artificial Sequence
  source: /note="Description of Artificial Sequence: Synthetic polypeptide"
  source: /note="DT ribotoxic region polypeptide variant 3"
GADDVVDSSKSFVMENFSSYHGTKPGYVDSIQKGIQKPKSGTQGNYDDDWKGFSSTDNKYDAAGYSVDNENPLSGKAGGVVKVTYPGLTKVLALKVDNAETIKKELGLSLTEPLMEQVGTEEFIKRFGDGASRVVLSLPFAEGSSSVAYINNWEQAKALSVELEINFETRGKRGQDAMYEYMAQACAGNRVRRSVGSSLSCINLDWDVIRDKTKTKIESLKEHGPIKNKMSESPNKTVSEEKAKQYLEEFHQTALEHPELSELKTVTGTNPVFAGANYAAWAVNVAQVIDSETADNLEKTTAALSILPGIGSVMGIADGAVHHNTEEIVAQSIALSSLMVAQAIPLVGELVDIGFAAYNFVESIINLFQVVHNSYNRPAYSPGHKTQP

SEQ ID NO: 20 - protein, 211 aa, Artificial Sequence
  source: /note="Description of Artificial Sequence: Synthetic polypeptide"
  source: /note="ricin ribotoxic region polypeptide variant 1"
FTTAGATVQSYTNFIRAVRGRLTTGADVRHEIPVLPNRVGLPINQRFILVELSNHAELSVTLALDVTNAYVVGYRAGNSAYFFHPDNQEDAEAITHLFTDVQNRYTFAFGGNSDRLEQLAGNLRENIELGNGPLEEAISALYYYSTGGTQLPTLARSFIICIQMISDAARFQYIEGEMRTRIRYNRRSAPDPSVITLENSWGRLSTAIQES

SEQ ID NO: 21 - protein, 267 aa, Artificial Sequence
  source: /note="Description of Artificial Sequence: Synthetic polypeptide"
  source: /note="ricin ribotoxic region polypeptide variant 2"
IFPKQYPIINFTTAGATVQSYTNFIRAVRGRLTTGADVRHEIPVLPNRVGLPINQRFILVELSNHAELSVTLALDVTNAYVVGYRAGNSAYFFHPDNQEDAEAITHLFTDVQNRYTFAFGGNADRLEQLAGNLRENIELGNGPLEEAISALYYYSTGGTQLPTLARSFIICIQMISDAARFQYIEGEMRTRIRYNRRSAPDPSVITLENSWGRLSTAIQESNQGAFASPIQLQRRNGSKFSVYDVSILIPIIALMVYRCAPPPSSQF

SEQ ID NO: 22 - protein, 266 aa, Artificial Sequence
  source: /note="Description of Artificial Sequence: Synthetic polypeptide"
  source: /note="ricin ribotoxic region polypeptide variant 3"
VPKQYPIINFTTAGATVQSYTNFIRAVRGRLTTGADVRHEIPVLPNRVGLPINQRFILVELSNHAELSVTLALDVTNAYVVGYRAGNSAYFFHPDNQEDAEAITHLFTDVQNRYTFAFGGNSDRLEQLAGNLRENIELGNGPLEEAISALYYYSTGGTQLPTLARSFIICIQMISAAARFQYIEGEMRTRIRYNRRSAPDPSVITLENSWGRLSTAIQESNQGAFASPIQLQRRNGSKFSVYDVSILIPIIALMVYRCAPPPSSQF

SEQ ID NO: 23 - protein, 128 aa, Artificial Sequence
  source: /note="Description of Artificial Sequence: Synthetic polypeptide"
  source: /note="sarcin ribotoxic region polypeptide variant 1"
RLLYNQNKAESNSHHAPLSDGKTGSSYPAWFTNGYDGDGKLPKGRTPIKFGKSDCDRPPKHSKDGNGKTDHYLLAFPTFPDGHDYKFDSKKPKENPGPARVIYTYPNKVFCGIIAHTKENQGELKLCS

SEQ ID NO: 24 - protein, 150 aa, Artificial Sequence
  source: /note="Description of Artificial Sequence: Synthetic polypeptide"
  source: /note="sarcin ribotoxic region polypeptide variant 2"
AVTWTCLNDQKNPKTNKYETKRLLYNQNKAESNSHHAPLSDGKTGSSYPAWFTNGYDGDGKLPKGRTPIKFGKSDCDRPPKHSKDGNGKTDHYLLAFPTFPDGHDYKFDSKKPKENPGPARVIYTYPNKVFCGIIAHTKENQGELKLCSH

SEQ ID NO: 25 - protein, 347 aa, Artificial Sequence
  source: /note="Description of Artificial Sequence: Synthetic polypeptide"
  source: /note="PE ribotoxic region polypeptide variant 1"
PEGGSLAALTAHQACHLPLETFTRHRQPRGWEQLEQCGYPVQRLVALYLAARLSWNQVDQVIRNALASPGSGGDLGEAIREQPEQARLALTLAAAESERFVRQGTGNDEAGAANGPADSGDALLERNYPTGAEFLGDGGDVSFSTRGTQNWTVERLLQAHRQLEERGYVFVGYHGTFLEAAQSIVFGGVRARSQDLDAIWRGFYIAGDPALAYGYAQDQEPDARGRIRNGALLRVYVPRSSLPGFYRTSLTLAAPEAAGEVERLIGHPLPLRLDAITGPEEEGGALATILGWPLAERTVVIPSAIPTDPRNVGGDLDPSSIPDKEQAISALPDYASQPGKPPREDLK

SEQ ID NO: 26 - protein, 362 aa, Artificial Sequence
  source: /note="Description of Artificial Sequence: Synthetic polypeptide"
  source: /note="PE ribotoxic region polypeptide variant 2"
VLAGNPAKHDLDIKPTVISHRLHFPEGGSLAALTAHQACHLPLETFTRHRQPRGWEQLEQCGYPVQRLVALYLAARLSWNQVDQVIRNALASPGSGGDLGEAIREQPEQARLALTLAAAESERFVRQGTGNDEAGAASADVVSLTCPVAAGECAGPADSGDALLERNYPTGAEFLGDGGDISFSTRGTQNWTVERLLQAHRQLEERGYVFVGYHGTFLEAAQSIVFGGVRARSQDLDAIWRGFYIAGDPALAYGYAQDQEPDARGRIRNGALLRVYVPRSSLPGFYRTGLTLAAPEAAGEVERLIGHPLPLRLDAITGPEEEGGALATILGWPLAERTVVIPSAIPTDPRNVGGDLDPSSIP

SEQ ID NO: 27 - protein, 419 aa, Artificial Sequence
  source: /note="Description of Artificial Sequence: Synthetic polypeptide"
  source: /note="PE ribotoxic region polypeptide variant 3"
AAAVVSHFNDCPDSHTQFCFHGTCRFLVQEDKPACVCHSGYVGARCEHADLLAAMAEEGGSLAALTAHQACHLPLETFTRHRQPRGWEQLEQCGYPVQRLVALYLAARLSWNQVDQVIRNALASPGSGGDLGEAIREQPEQARLALTLAAAESERFVRQGTGNDEAGAANADVVSLTCPVAAGECAGPADSGDALLERNYPTGAEFLGDGGDVSFSTRGTQNWTVERLLQAHRQLEERGYVFVGYHGTFLEAAQSIVFGGVRARSQDLDAIWRGFYIAGDPALAYGYAQDQEPDARGRIRNGALLRVYVPRSSLPGFYRTSLTLAAPEAAGEVERLIGHPLPLRLDAITGPEEEGGALATILGWPLAERTVVIPSAIPTDPRNVGGDLDPSSIPDKEQAISALPDYASQPGKPPREDLK

SEQ ID NO: 28 - protein, 419 aa, Artificial Sequence
  source: /note="Description of Artificial Sequence: Synthetic polypeptide"
  source: /note="PE ribotoxic region polypeptide variant 4"
AAAVVSHFNDCPDSHTQFCFHGTCRFLVQEDKPACVCHSGYVGARCEHADLLAAMAEEGGSLAALTAHQAAHLPLETLTRHRQPRGWEQLEQAGYPVQRLVALYLAARLSWNQVDQVIRNALASPGSGGDLGEAIREQPEQARLALTLAAAESERFVRQGTGNDEAGAANADVVSLTCPVAAGECAGPADSGDALLERNYPTEAEFLGDGGDVSFSTRGTQNWTVERLLQAHRQLEERGYVFVGYHGTFLEAAQSIVFGGVRARSQDLDAIWRGFYIAGDPALAYGYAQDQEPDARGRIRNGALLRVYVPRSSLPGFYRTSLTLAAPEAAGEVERLIGHPLPLRLDAITGPEEEGGALATILGWPLAERTVVIPSAIPTDPRNVGGDLDPSSIPDKEQAISALPDYASQPGKPPREDLK

SEQ ID NO: 29 - protein, 419 aa, Artificial Sequence
  source: /note="Description of Artificial Sequence: Synthetic polypeptide"
  source: /note="PE ribotoxic region polypeptide variant 5"
AAAVVSHFNDCPDSHTQFCFHGTCRFLVQEDKPACVCHSGYVGARCEHADLLAAMAEEGGSLAALTAHQACHLPLETFTRHRQPRGWEQLEQCGYPVQRLVALYLAARLSWNQVDQVIRNALASPGSGGDLGEAIREQPEQARLALTLAAAESERFVRQGTGNDEAGAANADVVTLTAPVAAGEAAGPADSGDALLERNYPTGAEFLGDGGDVSFSTRGTQNWTVERLLQAHRQLEERGYVFVGYHGTFLEAAQSIVFGGVRARSQDLDAIWRGFYIAGDPALAYGYAQDQEPDARGRIRNGALLRVYVPRSSLPGFYRTSLTLAAPEAAGEVERLIGHPLPLRLDAITGPEEEGGALATILGWPLAERTVVIPSAIPTDPRNVGGDLDPSSIPDKEQAISALPDYASQPGKPPREDLK

SEQ ID NO: 30 - protein, 419 aa, Artificial Sequence
  source: /note="Description of Artificial Sequence: Synthetic polypeptide"
  source: /note="PE ribotoxic region polypeptide variant 6 (PE40)"
AAAVVSHFNDCPDSHTQFCFHGTCRFLVQEDKPACVCHSGYVGARCEHADLLAAMAEEGGSLAALTAHQAAHLPLETLTRHRQPRGWEQLEQAGYPVQRLVALYLAARLSWNQVDQVIRNALASPGSGGDLGEAIREQPEQARLALTLAAAESERFVRQGTGNDEAGAANADVVTLTAPVAAGEAAGPADSGDALLERNYPTGAEFLGDGGDVSFSTRGTQNWTVERLLQAHRQLEERGYVFVGYHGTFLEAAQSIVFGGVRARSQDLDAIWRGFYIAGDPALAYGYAQDQEPDARGRIRNGALLRVYVPRSSLPGFYRTSLTLAAPEAAGEVERLIGHPLPLRLDAITGPEEEGGALATILGWPLAERTVVIPSAIPTDPRNVGGDLDPSSIPDKEQAISALPDYASQPGKPPREDLK

SEQ ID NO: 31 - protein, 362 aa, Artificial Sequence
  source: /note="Description of Artificial Sequence: Synthetic polypeptide"
  source: /note="PE ribotoxic region polypeptide variant variant 7"
PEGGSLAALTAHQACHLPLETFTRHRQPRGWEQLEQCGYPVQRLVALYLAARLSWNQVDQVIRNALASPGSGGDLGEAIREQPEQARLALTLAAAESERFVRQGTGNDEAGAANADVVSLTCPVAAGECAGPADSGDALLERNYPTGAEFLGDGGDVSFSTRGTQNWTVERLLQAHRQLEERGYVFVGYHGTFLEAAQSIVFGGVRARSQDLDAIWRGFYIAGDPALAYGYAQDQEPDARGRIRNGALLRVYVPRSSLPGFYRTSLTLAAPEAAGEVERLIGHPLPLRLDAITGPEEEGGALATILGWPLAERTVVIPSAIPTDPRNVGGDLDPSSIPDKEQAISALPDYASQPGKPPKDEL

SEQ ID NO: 32 - protein, 258 aa, Artificial Sequence
  source: /note="Description of Artificial Sequence: Synthetic polypeptide"
  source: /note="gelonin ribotoxic region polypeptide"
GLDTVSFSTKGATYITYVNFLNELRVKLKPEGNSHGIPLLRKGDDPGKCFVLVALSNDNGQLAEIAIDVTSVAVVGYQVRNRSYFFKDAPDAAYEGLFKNTIKNPLLFGGKTRLHFGGSYPSLEGEKAYRETTDLGIEPLRIGIKKLDENAIDNYKPTEIASSLLVVIQMVSAAARFTFIENQIRNNFQQRIRPANNTISLENKWGKLSFQIRTSGANGMFSEAVELERANGKKYYVTAVDQVKPKIALLKFVDKDPE

SEQ ID NO: 33 - protein, 213 aa, Artificial Sequence
  source: /note="Description of Artificial Sequence: Synthetic polypeptide"
  source: /note="saporin ribotoxic region polypeptide variant 1"
SITLDLVNPTAGQYSSFVDKIRNNVKDPNLKYGGTDIAVIGPPSKEKFLRINFQSSRGTVSLGLKRDNLSVVAYLAMDNTNVNRAYYFRSEITSAELTALFPEATTANQKALEYTEDYQSIEKNAQITQGDKSRKELGLGIDLLLTFMEAVNKKARVVKNEARFLLIAIQMTADVARFRYIQNLVTKNFPNKFDSDNKVIQFEVSWRKISTAI

SEQ ID NO: 34 - protein, 291 aa, Artificial Sequence
  source: /note="Description of Artificial Sequence: Synthetic polypeptide"
  source: /note="saporin ribotoxic region polypeptide variant 2"
KIYVVATIAWILLQFSAWTTTDAVTSITLDLVNPTAGQYSSFVDKIRNNVKDPNLKYGGTDIAVIGPPSKDKFLRINFQSSRGTVSLGLKRDNLAVVAYLAMDNTNVNRAYYFKSEITSAELTALFPEATTANQKALEYTEDYQSIEKNAQITQGDKSRKELGLGIDLLLTFMEAVNKKARVVKNEARFLLIAIQMTADVARFRYIQNLVTKNFPNKFDSDNKVIQFEVSWRKISTAIYGDAKNGVFNKDYDFGFGKVRQVKDLQMGLLMYLGKPKSSNEANSTAYATTVL

SEQ ID NO: 35 - protein, 253 aa, Artificial Sequence
  source: /note="Description of Artificial Sequence: Synthetic polypeptide"
  source: /note="saporin ribotoxic region polypeptide variant 3"
VTSITLDLVNPTAGQYSSFVDKIRNNVKDPNLKYGGTDIAVIGPPSKEKFLRINFQSSRGTVSLGLKRDNLAVVAYLAMDNTNVNRAYYFRSEITSAELTALFPEATTANQKALEYTEDYQSIEKNAQITQGDKSRKELGLGIDLLLTFMEAVNKKARVVKNEARFLLIAIQMTAAVARFRYIQNLVTKNFPNKFDSDNKVIQFEVSWRKISTAIYGDAKNGVFNKDYDFGFGKVRQVKDLQMGLLMYLGKPK

SEQ ID NO: 36 - protein, 247 aa, Artificial Sequence
  source: /note="Description of Artificial Sequence: Synthetic polypeptide"
  source: /note="bryodin ribotoxic region polypeptide"
DVSFRLSGATTTSYGVFIKNLREALPYERKVYNIPLLRSSISGSGRYTLLHLTNYADETISVAVDVTNVAIMGYLAGDVSYFFNEASATEAAKFVFKDAKKKVTLPYSGNYERLQTAAGKIRENIPLGLPALDSAITTLYYYTASSAASALLVLIQSTAASARYKFIEQQIGKRVDKTFLPSLATISLENNWSALSKQIQIASTNNGQFESPVVLIDGNNQRVSITNASARVVTSNIALLLNRNNIA

SEQ ID NO: 37 - protein, 175 aa, Artificial Sequence
  source: /note="Description of Artificial Sequence: Synthetic polypeptide"
  source: /note="Aspf1 ribotoxic region polypeptide"
VAIKNLFLLAATAVSVLAAPSPLDARATWTCINQQLNPKTNKWEDKRLLYSQAKAESNSHHAPLSDGKTGSSYPAWFTNGYDGNGKLIKGRTPIKFGKADCDRPPKHSQNGMGKDDHYLLAFPTFPDGHDYKFDSKKPKEDPGPARVIYTYPNKVFCGIVAHQRGNQGDLRLCSH

SEQ ID NO: 38 - protein, 149 aa, Artificial Sequence
  source: /note="Description of Artificial Sequence: Synthetic polypeptide"
  source: /note="restrictocin ribotoxic region polypeptide"
ATWTCINQQLNPKTNKWEDKRLLYSQAKAESNSHHAPLSDGKTGSSYPAWFTNGYDGNGKLIKGRTPIKFGKADCDRPPKHSQNGMGKDDHYLLAFPTFPDGHDYKFDSKKPKENPGPARVIYTYPNKVFCGIVAHQRGNQGDLRLCSH

SEQ ID NO: 39 - protein, 176 aa, Artificial Sequence
  source: /note="Description of Artificial Sequence: Synthetic polypeptide"
  source: /note="clavin ribotoxic region polypeptide"
VAIKNLVLVALTAVTALAMPSPLEERAATWTCMNEQKNPKTNKYENKRLLYNQNNAESNAHHAPLSDGKTGSSYPAWFTNGYDGDGKILKGRTPIKWGNSDCDRPPKHSKNGDGKNDHYLLAFPTFPDGHQYNFDSKKPKEDPGPARVIYTYPNKVFCGIVAHTRENQGDLKLCSH

SEQ ID NO: 40 - DNA, 498 bp, Artificial Sequence
  source: /note="Description of Artificial Sequence: Synthetic polynucleotide"
  source: /note="Shiga toxin ribotoxic region polynucleotide variant 1"
  modified_base (6)..(6): a, c, t, g, unknown or other
  modified_base (9)..(9): a, c, t, g, unknown or other
  modified_base (12)..(12): a, c, t, g, unknown or other
  modified_base (15)..(15): a, c, t, g, unknown or other
  modified_base (18)..(18): a, c, t, g, unknown or other
  modified_base (24)..(24): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (51)..(51): a, c, t, g, unknown or other
  modified_base (57)..(57): a, c, t, g, unknown or other
  modified_base (66)..(66): a, c, t, g, unknown or other
  modified_base (72)..(72): a, c, t, g, unknown or other
  modified_base (75)..(75): a, c, t, g, unknown or other
  modified_base (81)..(81): a, c, t, g, unknown or other
  modified_base (84)..(84): a, c, t, g, unknown or other
  modified_base (87)..(87): a, c, t, g, unknown or other
  modified_base (90)..(90): a, c, t, g, unknown or other
  modified_base (93)..(93): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (105)..(105): a, c, t, g, unknown or other
  modified_base (108)..(108): a, c, t, g, unknown or other
  modified_base (114)..(114): a, c, t, g, unknown or other
  modified_base (117)..(117): a, c, t, g, unknown or other
  modified_base (123)..(123): a, c, t, g, unknown or other
  modified_base (126)..(126): a, c, t, g, unknown or other
  modified_base (129)..(129): a, c, t, g, unknown or other
  modified_base (135)..(135): a, c, t, g, unknown or other
  modified_base (138)..(138): a, c, t, g, unknown or other
  modified_base (141)..(141): a, c, t, g, unknown or other
  modified_base (144)..(144): a, c, t, g, unknown or other
  modified_base (150)..(150): a, c, t, g, unknown or other
  modified_base (153)..(153): a, c, t, g, unknown or other
  modified_base (156)..(156): a, c, t, g, unknown or other
  modified_base (159)..(159): a, c, t, g, unknown or other
  modified_base (174)..(174): a, c, t, g, unknown or other
  modified_base (180)..(180): a, c, t, g, unknown or other
  modified_base (183)..(183): a, c, t, g, unknown or other
  modified_base (186)..(186): a, c, t, g, unknown or other
  modified_base (189)..(189): a, c, t, g, unknown or other
  modified_base (192)..(192): a, c, t, g, unknown or other
  modified_base (198)..(198): a, c, t, g, unknown or other
  modified_base (204)..(204): a, c, t, g, unknown or other
  modified_base (210)..(210): a, c, t, g, unknown or other
  modified_base (216)..(216): a, c, t, g, unknown or other
  modified_base (219)..(219): a, c, t, g, unknown or other
  modified_base (222)..(222): a, c, t, g, unknown or other
  modified_base (225)..(225): a, c, t, g, unknown or other
  modified_base (228)..(228): a, c, t, g, unknown or other
  modified_base (231)..(231): a, c, t, g, unknown or other
  modified_base (237)..(237): a, c, t, g, unknown or other
  modified_base (240)..(240): a, c, t, g, unknown or other
  modified_base (243)..(243): a, c, t, g, unknown or other
  modified_base (246)..(246): a, c, t, g, unknown or other
  modified_base (249)..(249): a, c, t, g, unknown or other
  modified_base (255)..(255): a, c, t, g, unknown or other
  modified_base (258)..(258): a, c, t, g, unknown or other
  modified_base (264)..(264): a, c, t, g, unknown or other
  modified_base (267)..(267): a, c, t, g, unknown or other
  modified_base (270)..(270): a, c, t, g, unknown or other
  modified_base (273)..(273): a, c, t, g, unknown or other
  modified_base (276)..(276): a, c, t, g, unknown or other
  modified_base (282)..(282): a, c, t, g, unknown or other
  modified_base (285)..(285): a, c, t, g, unknown or other
  modified_base (288)..(288): a, c, t, g, unknown or other
  modified_base (294)..(294): a, c, t, g, unknown or other
  modified_base (306)..(306): a, c, t, g, unknown or other
  modified_base (309)..(309): a, c, t, g, unknown or other
  modified_base (315)..(315): a, c, t, g, unknown or other
  modified_base (318)..(318): a, c, t, g, unknown or other
  modified_base (321)..(321): a, c, t, g, unknown or other
  modified_base (324)..(324): a, c, t, g, unknown or other
  modified_base (333)..(333): a, c, t, g, unknown or other
  modified_base (336)..(336): a, c, t, g, unknown or other
  modified_base (339)..(339): a, c, t, g, unknown or other
  modified_base (342)..(342): a, c, t, g, unknown or other
  modified_base (345)..(345): a, c, t, g, unknown or other
  modified_base (351)..(351): a, c, t, g, unknown or other
  modified_base (357)..(357): a, c, t, g, unknown or other
  modified_base (360)..(360): a, c, t, g, unknown or other
  modified_base (369)..(369): a, c, t, g, unknown or other
  modified_base (375)..(375): a, c, t, g, unknown or other
  modified_base (378)..(378): a, c, t, g, unknown or other
  modified_base (381)..(381): a, c, t, g, unknown or other
  modified_base (390)..(390): a, c, t, g, unknown or other
  modified_base (393)..(393): a, c, t, g, unknown or other
  modified_base (396)..(396): a, c, t, g, unknown or other
  modified_base (399)..(399): a, c, t, g, unknown or other
  modified_base (402)..(402): a, c, t, g, unknown or other
  modified_base (405)..(405): a, c, t, g, unknown or other
  modified_base (408)..(408): a, c, t, g, unknown or other
  modified_base (411)..(411): a, c, t, g, unknown or other
  modified_base (423)..(423): a, c, t, g, unknown or other
  modified_base (432)..(432): a, c, t, g, unknown or other
  modified_base (435)..(435): a, c, t, g, unknown or other
  modified_base (438)..(438): a, c, t, g, unknown or other
  modified_base (441)..(441): a, c, t, g, unknown or other
  modified_base (444)..(444): a, c, t, g, unknown or other
  modified_base (447)..(447): a, c, t, g, unknown or other
  modified_base (453)..(453): a, c, t, g, unknown or other
  modified_base (459)..(459): a, c, t, g, unknown or other
  modified_base (462)..(462): a, c, t, g, unknown or other
  modified_base (471)..(471): a, c, t, g, unknown or other
  modified_base (477)..(477): a, c, t, g, unknown or other
  modified_base (480)..(480): a, c, t, g, unknown or other
  modified_base (483)..(483): a, c, t, g, unknown or other
  modified_base (486)..(486): a, c, t, g, unknown or other
  modified_base (489)..(489): a, c, t, g, unknown or other
  modified_base (492)..(492): a, c, t, g, unknown or other
  modified_base (498)..(498): a, c, t, g, unknown or other
aayytnwsngtnacnggnttygtnaaymgnacnaayaaygtnttytaymgnttygcngayttywsncaygtnacnttyccnggnacnacngcngtnacnytnwsnggngaywsnwsntayacnacnytncarmgngtngcnggnathwsnmgnacnggnatgcarathaaymgncaywsnytnacnacnwsntayytngayytnatgwsncaywsnggnacnwsnytnacncarwsngtngcnmgngcnatgytnmgnttygtnacngtnacngcngaygcnytnmgnttymgncarathcarmgnggnttymgnacnacnytngaygayytnwsnggnmgnwsntaygtnatgacngcngargaygtngayytnacnytnaaytggggnmgnytnwsnwsngtnytnccngaytaycayggncargaywsngtnmgngtnggnmgnathwsnttyggnwsnathaaygcnathytnggnwsngtngcnytnathytn

SEQ ID NO: 41 - DNA, 753 bp, Artificial Sequence
  source: /note="Description of Artificial Sequence: Synthetic polynucleotide"
  source: /note="Shiga toxin ribotoxic region polynucleotide variant 2"
  modified_base (12)..(12): a, c, t, g, unknown or other
  modified_base (15)..(15): a, c, t, g, unknown or other
  modified_base (24)..(24): a, c, t, g, unknown or other
  modified_base (27)..(27): a, c, t, g, unknown or other
  modified_base (30)..(30): a, c, t, g, unknown or other
  modified_base (36)..(36): a, c, t, g, unknown or other
  modified_base (42)..(42): a, c, t, g, unknown or other
  modified_base (48)..(48): a, c, t, g, unknown or other
  modified_base (51)..(51): a, c, t, g, unknown or other
  modified_base (57)..(57): a, c, t, g, unknown or other
  modified_base (63)..(63): a, c, t, g, unknown or other
  modified_base (66)..(66): a, c, t, g, unknown or other
  modified_base (69)..(69): a, c, t, g, unknown or other
  modified_base (75)..(75): a, c, t, g, unknown or other
  modified_base (78)..(78): a, c, t, g, unknown or other
  modified_base (81)..(81): a, c, t, g, unknown or other
  modified_base (84)..(84): a, c, t, g, unknown or other
  modified_base (90)..(90): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (105)..(105): a, c, t, g, unknown or other
  modified_base (108)..(108): a, c, t, g, unknown or other
  modified_base (111)..(111): a, c, t, g, unknown or other
  modified_base (114)..(114): a, c, t, g, unknown or other
  modified_base (117)..(117): a, c, t, g, unknown or other
  modified_base (129)..(129): a, c, t, g, unknown or other
  modified_base (132)..(132): a, c, t, g, unknown or other
  modified_base (135)..(135): a, c, t, g, unknown or other
  modified_base (138)..(138): a, c, t, g, unknown or other
  modified_base (147)..(147): a, c, t, g, unknown or other
  modified_base (153)..(153): a, c, t, g, unknown or other
  modified_base (156)..(156): a, c, t, g, unknown or other
  modified_base (162)..(162): a, c, t, g, unknown or other
  modified_base (165)..(165): a, c, t, g, unknown or other
  modified_base (168)..(168): a, c, t, g, unknown or other
  modified_base (177)..(177): a, c, t, g, unknown or other
  modified_base (186)..(186): a, c, t, g, unknown or other
  modified_base (189)..(189): a, c, t, g, unknown or other
  modified_base (201)..(201): a, c, t, g, unknown or other
  modified_base (204)..(204): a, c, t, g, unknown or other
  modified_base (207)..(207): a, c, t, g, unknown or other
  modified_base (213)..(213): a, c, t, g, unknown or other
  modified_base (219)..(219): a, c, t, g, unknown or other
  modified_base (228)..(228): a, c, t, g, unknown or other
  modified_base (231)..(231): a, c, t, g, unknown or other
  modified_base (234)..(234): a, c, t, g, unknown or other
  modified_base (237)..(237): a, c, t, g, unknown or other
  modified_base (240)..(240): a, c, t, g, unknown or other
  modified_base (246)..(246): a, c, t, g, unknown or other
  modified_base (252)..(252): a, c, t, g, unknown or other
  modified_base (255)..(255): a, c, t, g, unknown or other
  modified_base (264)..(264): a, c, t, g, unknown or other
  modified_base (273)..(273): a, c, t, g, unknown or other
  modified_base (279)..(279): a, c, t, g, unknown or other
  modified_base (288)..(288): a, c, t, g, unknown or other
  modified_base (294)..(294): a, c, t, g, unknown or other
  modified_base (297)..(297): a, c, t, g, unknown or other
  modified_base (303)..(303): a, c, t, g, unknown or other
  modified_base (306)..(306): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (318)..(318): a, c, t, g, unknown or other
  modified_base (321)..(321): a, c, t, g, unknown or other
  modified_base (324)..(324): a, c, t, g, unknown or other
  modified_base (327)..(327): a, c, t, g, unknown or other
  modified_base (330)..(330): a, c, t, g, unknown or other
  modified_base (336)..(336): a, c, t, g, unknown or other
  modified_base (339)..(339): a, c, t, g, unknown or other
  modified_base (345)..(345): a, c, t, g, unknown or other
  modified_base (348)..(348): a, c, t, g, unknown or other
  modified_base (351)..(351): a, c, t, g, unknown or other
  modified_base (357)..(357): a, c, t, g, unknown or other
  modified_base (360)..(360): a, c, t, g, unknown or other
  modified_base (363)..(363): a, c, t, g, unknown or other
  modified_base (366)..(366): a, c, t, g, unknown or other
  modified_base (372)..(372): a, c, t, g, unknown or other
  modified_base (375)..(375): a, c, t, g, unknown or other
  modified_base (378)..(378): a, c, t, g, unknown or other
  modified_base (381)..(381): a, c, t, g, unknown or other
  modified_base (396)..(396): a, c, t, g, unknown or other
  modified_base (402)..(402): a, c, t, g, unknown or other
  modified_base (405)..(405): a, c, t, g, unknown or other
  modified_base (408)..(408): a, c, t, g, unknown or other
  modified_base (411)..(411): a, c, t, g, unknown or other
  modified_base (414)..(414): a, c, t, g, unknown or other
  modified_base (420)..(420): a, c, t, g, unknown or other
  modified_base (426)..(426): a, c, t, g, unknown or other
  modified_base (432)..(432): a, c, t, g, unknown or other
  modified_base (438)..(438): a, c, t, g, unknown or other
  modified_base (441)..(441): a, c, t, g, unknown or other
  modified_base (444)..(444): a, c, t, g, unknown or other
  modified_base (447)..(447): a, c, t, g, unknown or other
  modified_base (450)..(450): a, c, t, g, unknown or other
  modified_base (453)..(453): a, c, t, g, unknown or other
  modified_base (459)..(459): a, c, t, g, unknown or other
  modified_base (462)..(462): a, c, t, g, unknown or other
  modified_base (465)..(465): a, c, t, g, unknown or other
  modified_base (468)..(468): a, c, t, g, unknown or other
  modified_base (471)..(471): a, c, t, g, unknown or other
  modified_base (477)..(477): a, c, t, g, unknown or other
  modified_base (480)..(480): a, c, t, g, unknown or other
  modified_base (486)..(486): a, c, t, g, unknown or other
  modified_base (489)..(489): a, c, t, g, unknown or other
  modified_base (492)..(492): a, c, t, g, unknown or other
  modified_base (495)..(495): a, c, t, g, unknown or other
  modified_base (498)..(498): a, c, t, g, unknown or other
  modified_base (504)..(504): a, c, t, g, unknown or other
  modified_base (507)..(507): a, c, t, g, unknown or other
  modified_base (510)..(510): a, c, t, g, unknown or other
  modified_base (516)..(516): a, c, t, g, unknown or other
  modified_base (528)..(528): a, c, t, g, unknown or other
  modified_base (531)..(531): a, c, t, g, unknown or other
  modified_base (537)..(537): a, c, t, g, unknown or other
  modified_base (540)..(540): a, c, t, g, unknown or other
  modified_base (543)..(543): a, c, t, g, unknown or other
  modified_base (546)..(546): a, c, t, g, unknown or other
  modified_base (555)..(555): a, c, t, g, unknown or other
  modified_base (558)..(558): a, c, t, g, unknown or other
  modified_base (561)..(561): a, c, t, g, unknown or other
  modified_base (564)..(564): a, c, t, g, unknown or other
  modified_base (567)..(567): a, c, t, g, unknown or other
  modified_base (573)..(573): a, c, t, g, unknown or other
  modified_base (579)..(579): a, c, t, g, unknown or other
  modified_base (582)..(582): a, c, t, g, unknown or other
  modified_base (591)..(591): a, c, t, g, unknown or other
  modified_base (597)..(597): a, c, t, g, unknown or other
  modified_base (600)..(600): a, c, t, g, unknown or other
  modified_base (603)..(603): a, c, t, g, unknown or other
  modified_base (612)..(612): a, c, t, g, unknown or other
  modified_base (615)..(615): a, c, t, g, unknown or other
  modified_base (618)..(618): a, c, t, g, unknown or other
  modified_base (621)..(621): a, c, t, g, unknown or other
  modified_base (624)..(624): a, c, t, g, unknown or other
  modified_base (627)..(627): a, c, t, g, unknown or other
  modified_base (630)..(630): a, c, t, g, unknown or other
  modified_base (633)..(633): a, c, t, g, unknown or other
  modified_base (645)..(645): a, c, t, g, unknown or other
  modified_base (654)..(654): a, c, t, g, unknown or other
  modified_base (657)..(657): a, c, t, g, unknown or other
  modified_base (660)..(660): a, c, t, g, unknown or other
  modified_base (663)..(663): a, c, t, g, unknown or other
  modified_base (666)..(666): a, c, t, g, unknown or other
  modified_base (669)..(669): a, c, t, g, unknown or other
  modified_base (675)..(675): a, c, t, g, unknown or other
  modified_base (681)..(681): a, c, t, g, unknown or other
  modified_base (684)..(684): a, c, t, g, unknown or other
  modified_base (693)..(693): a, c, t, g, unknown or other
  modified_base (699)..(699): a, c, t, g, unknown or other
  modified_base (702)..(702): a, c, t, g, unknown or other
  modified_base (705)..(705): a, c, t, g, unknown or other
  modified_base (708)..(708): a, c, t, g, unknown or other
  modified_base (711)..(711): a, c, t, g, unknown or other
  modified_base (714)..(714): a, c, t, g, unknown or other
  modified_base (720)..(720): a, c, t, g, unknown or other
  modified_base (738)..(738): a, c, t, g, unknown or other
  modified_base (741)..(741): a, c, t, g, unknown or other
  modified_base (744)..(744): a, c, t, g, unknown or other
  modified_base (747)..(747): a, c, t, g, unknown or other
  modified_base (750)..(750): a, c, t, g, unknown or other
  modified_base (753)..(753): a, c, t, g, unknown or other
aargarttyacnytngayttywsnacngcnaaracntaygtngaywsnytnaaygtnathmgnwsngcnathggnacnccnytncaracnathwsnwsnggnggnacnwsnytnytnatgathgaywsnggnwsnggngayaayytnttygcngtngaygtnmgnggnathgayccngargarggnmgnttyaayaayytnmgnytnathgtngarmgnaayaayytnwsngtnacnggnttygtnaaymgnacnaayaaygtnttytaymgnttygcngayttywsncaygtnacnttyccnggnacnacngcngtnacnytnwsnggngaywsnwsntayacnacnytncarmgngtngcnggnathwsnmgnacnggnatgcarathaaymgncaywsnytnacnacnwsntayytngayytnatgwsncaywsnggnacnwsnytnacncarwsngtngcnmgngcnatgytnmgnttygtnacngtnacngcngaygcnytnmgnttymgncarathcarmgnggnttymgnacnacnytngaygayytnwsnggnmgnwsntaygtnatgacngcngargaygtngayytnacnytnaaytggggnmgnytnwsnwsngtnytnccngaytaycayggncargaywsngtnmgngtnggnmgnathwsnttyggnwsnathaaygcnathytnggnwsngtngcnytnathytnaaytgycaycaycaygcnwsnmgngtngcnmgn

SEQ ID NO: 42 - DNA, 423 bp, Artificial Sequence
  source: /note="Description of Artificial Sequence: Synthetic polynucleotide"
  source: /note="DT ribotoxic region polynucleotide variant 1"
  modified_base (3)..(3): a, c, t, g, unknown or other
  modified_base (6)..(6): a, c, t, g, unknown or other
  modified_base (15)..(15): a, c, t, g, unknown or other
  modified_base (18)..(18): a, c, t, g, unknown or other
  modified_base (24)..(24): a, c, t, g, unknown or other
  modified_base (27)..(27): a, c, t, g, unknown or other
  modified_base (33)..(33): a, c, t, g, unknown or other
  modified_base (39)..(39): a, c, t, g, unknown or other
  modified_base (51)..(51): a, c, t, g, unknown or other
  modified_base (63)..(63): a, c, t, g, unknown or other
  modified_base (69)..(69): a, c, t, g, unknown or other
  modified_base (72)..(72): a, c, t, g, unknown or other
  modified_base (75)..(75): a, c, t, g, unknown or other
  modified_base (81)..(81): a, c, t, g, unknown or other
  modified_base (105)..(105): a, c, t, g, unknown or other
  modified_base (111)..(111): a, c, t, g, unknown or other
  modified_base (114)..(114): a, c, t, g, unknown or other
  modified_base (117)..(117): a, c, t, g, unknown or other
  modified_base (135)..(135): a, c, t, g, unknown or other
  modified_base (138)..(138): a, c, t, g, unknown or other
  modified_base (141)..(141): a, c, t, g, unknown or other
  modified_base (147)..(147): a, c, t, g, unknown or other
  modified_base (150)..(150): a, c, t, g, unknown or other
  modified_base (165)..(165): a, c, t, g, unknown or other
  modified_base (168)..(168): a, c, t, g, unknown or other
  modified_base (171)..(171): a, c, t, g, unknown or other
  modified_base (174)..(174): a, c, t, g, unknown or other
  modified_base (180)..(180): a, c, t, g, unknown or other
  modified_base (183)..(183): a, c, t, g, unknown or other
  modified_base (186)..(186): a, c, t, g, unknown or other
  modified_base (189)..(189): a, c, t, g, unknown or other
  modified_base (192)..(192): a, c, t, g, unknown or other
  modified_base (198)..(198): a, c, t, g, unknown or other
  modified_base (201)..(201): a, c, t, g, unknown or other
  modified_base (207)..(207): a, c, t, g, unknown or other
  modified_base (210)..(210): a, c, t, g, unknown or other
  modified_base (213)..(213): a, c, t, g, unknown or other
  modified_base (216)..(216): a, c, t, g, unknown or other
  modified_base (222)..(222): a, c, t, g, unknown or other
  modified_base (225)..(225): a, c, t, g, unknown or other
  modified_base (228)..(228): a, c, t, g, unknown or other
  modified_base (231)..(231): a, c, t, g, unknown or other
  modified_base (237)..(237): a, c, t, g, unknown or other
  modified_base (246)..(246): a, c, t, g, unknown or other
  modified_base (252)..(252): a, c, t, g, unknown or other
  modified_base (267)..(267): a, c, t, g, unknown or other
  modified_base (270)..(270): a, c, t, g, unknown or other
  modified_base (273)..(273): a, c, t, g, unknown or other
  modified_base (276)..(276): a, c, t, g, unknown or other
  modified_base (279)..(279): a, c, t, g, unknown or other
  modified_base (282)..(282): a, c, t, g, unknown or other
  modified_base (288)..(288): a, c, t, g, unknown or other
  modified_base (291)..(291): a, c, t, g, unknown or other
  modified_base (303)..(303): a, c, t, g, unknown or other
  modified_base (306)..(306): a, c, t, g, unknown or other
  modified_base (309)..(309): a, c, t, g, unknown or other
  modified_base (327)..(327): a, c, t, g, unknown or other
  modified_base (333)..(333): a, c, t, g, unknown or other
  modified_base (339)..(339): a, c, t, g, unknown or other
  modified_base (342)..(342): a, c, t, g, unknown or other
  modified_base (345)..(345): a, c, t, g, unknown or other
  modified_base (348)..(348): a, c, t, g, unknown or other
  modified_base (351)..(351): a, c, t, g, unknown or other
  modified_base (354)..(354): a, c, t, g, unknown or other
  modified_base (357)..(357): a, c, t, g, unknown or other
  modified_base (360)..(360): a, c, t, g, unknown or other
  modified_base (363)..(363): a, c, t, g, unknown or other
  modified_base (366)..(366): a, c, t, g, unknown or other
  modified_base (372)..(372): a, c, t, g, unknown or other
  modified_base (378)..(378): a, c, t, g, unknown or other
  modified_base (381)..(381): a, c, t, g, unknown or other
  modified_base (384)..(384): a, c, t, g, unknown or other
  modified_base (387)..(387): a, c, t, g, unknown or other
  modified_base (390)..(390): a, c, t, g, unknown or other
  modified_base (393)..(393): a, c, t, g, unknown or other
  modified_base (417)..(417): a, c, t, g, unknown or other
  modified_base (423)..(423): a, c, t, g, unknown or other
wsnwsntaycayggnacnaarccnggntaygtngaywsnathcaraarggnathcaraarccnaarwsnggnacncarggnaaytaygaygaygaytggaarggnttywsnwsnacngayaayaartaygaygcngcnggntaywsngtngayaaygaraayccnytnwsnggnaargcnggnggngtngtnaargtnacntayccnggnytnacnaargtnytngcnytnaargtngayaaygcngaracnathaaraargarytnggnytnwsnytnacngarccnytnatggarcargtnggnacngargarttyathaarmgnttyggngayggngcnwsnmgngtngtnytnwsnytnccnttygcngarggnwsnwsnwsngtngcntayathaayaaytgggarcargcnaargcn

SEQ ID NO: 43 - DNA, 1143 bp, Artificial Sequence
  source: /note="Description of Artificial Sequence: Synthetic polynucleotide"
  source: /note="DT ribotoxic region polynucleotide variant 2"
  modified_base (3)..(3): a, c, t, g, unknown or other
  modified_base (6)..(6): a, c, t, g, unknown or other
  modified_base (15)..(15): a, c, t, g, unknown or other
  modified_base (18)..(18): a, c, t, g, unknown or other
  modified_base (24)..(24): a, c, t, g, unknown or other
  modified_base (27)..(27): a, c, t, g, unknown or other
  modified_base (33)..(33): a, c, t, g, unknown or other
  modified_base (39)..(39): a, c, t, g, unknown or other
  modified_base (54)..(54): a, c, t, g, unknown or other
  modified_base (57)..(57): a, c, t, g, unknown or other
  modified_base (66)..(66): a, c, t, g, unknown or other
  modified_base (69)..(69): a, c, t, g, unknown or other
  modified_base (75)..(75): a, c, t, g, unknown or other
  modified_base (78)..(78): a, c, t, g, unknown or other
  modified_base (84)..(84): a, c, t, g, unknown or other
  modified_base (90)..(90): a, c, t, g, unknown or other
  modified_base (102)..(102): a, c, t, g, unknown or other
  modified_base (114)..(114): a, c, t, g, unknown or other
  modified_base (120)..(120): a, c, t, g, unknown or other
  modified_base (123)..(123): a, c, t, g, unknown or other
  modified_base (126)..(126): a, c, t, g, unknown or other
  modified_base (132)..(132): a, c, t, g, unknown or other
  modified_base (156)..(156): a, c, t, g, unknown or other
  modified_base (162)..(162): a, c, t, g, unknown or other
  modified_base (165)..(165): a, c, t, g, unknown or other
  modified_base (168)..(168): a, c, t, g, unknown or other
  modified_base (186)..(186): a, c, t, g, unknown or other
  modified_base (189)..(189): a, c, t, g, unknown or other
  modified_base (192)..(192): a, c, t, g, unknown or other
  modified_base (198)..(198): a, c, t, g, unknown or other
  modified_base (201)..(201): a, c, t, g, unknown or other
  modified_base (216)..(216): a, c, t, g, unknown or other
  modified_base (219)..(219): a, c, t, g, unknown or other
  modified_base (222)..(222): a, c, t, g, unknown or other
  modified_base (225)..(225): a, c, t, g, unknown or other
  modified_base (231)..(231): a, c, t, g, unknown or other
  modified_base (234)..(234): a, c, t, g, unknown or other
  modified_base (237)..(237): a, c, t, g, unknown or other
  modified_base (240)..(240): a, c, t, g, unknown or other
  modified_base (243)..(243): a, c, t, g, unknown or other
  modified_base (249)..(249): a, c, t, g, unknown or other
  modified_base (252)..(252): a, c, t, g, unknown or other
  modified_base (258)..(258): a, c, t, g, unknown or other
  modified_base (261)..(261): a, c, t, g, unknown or other
  modified_base (264)..(264): a, c, t, g, unknown or other
  modified_base (267)..(267): a, c, t, g, unknown or other
  modified_base (273)..(273): a, c, t, g, unknown or other
  modified_base (276)..(276): a, c, t, g, unknown or other
  modified_base (279)..(279): a, c, t, g, unknown or other
  modified_base (282)..(282): a, c, t, g, unknown or other
  modified_base (288)..(288): a, c, t, g, unknown or other
  modified_base (297)..(297): a, c, t, g, unknown or other
  modified_base (303)..(303): a, c, t, g, unknown or other
  modified_base (318)..(318): a, c, t, g, unknown or other
  modified_base (321)..(321): a, c, t, g, unknown or other
  modified_base (324)..(324): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (342)..(342): a, c, t, g, unknown or other
  modified_base (354)..(354): a, c, t, g, unknown or other
  modified_base (357)..(357): a, c, t, g, unknown or other
  modified_base (360)..(360): a, c, t, g, unknown or other
  modified_base (378)..(378): a, c, t, g, unknown or other
  modified_base (384)..(384): a, c, t, g, unknown or other
  modified_base (390)..(390): a, c, t, g, unknown or other
  modified_base (393)..(393): a, c, t, g, unknown or other
  modified_base (396)..(396): a, c, t, g, unknown or other
  modified_base (399)..(399): a, c, t, g, unknown or other
  modified_base (402)..(402): a, c, t, g, unknown or other
  modified_base (405)..(405): a, c, t, g, unknown or other
  modified_base (408)..(408): a, c, t, g, unknown or other
  modified_base (411)..(411): a, c, t, g, unknown or other
  modified_base (414)..(414): a, c, t, g, unknown or other
  modified_base (417)..(417): a, c, t, g, unknown or other
  modified_base (423)..(423): a, c, t, g, unknown or other
  modified_base (429)..(429): a, c, t, g, unknown or other
  modified_base (432)..(432): a, c, t, g, unknown or other
  modified_base (435)..(435): a, c, t, g, unknown or other
  modified_base (438)..(438): a, c, t, g, unknown or other
  modified_base (441)..(441): a, c, t, g, unknown or other
  modified_base (444)..(444): a, c, t, g, unknown or other
  modified_base (468)..(468): a, c, t, g, unknown or other
  modified_base (474)..(474): a, c, t, g, unknown or other
  modified_base (477)..(477): a, c, t, g, unknown or other
  modified_base (480)..(480): a, c, t, g, unknown or other
  modified_base (483)..(483): a, c, t, g, unknown or other
  modified_base (489)..(489): a, c, t, g, unknown or other
  modified_base (507)..(507): a, c, t, g, unknown or other
  modified_base (510)..(510): a, c, t, g, unknown or other
  modified_base (513)..(513): a, c, t, g, unknown or other
  modified_base (519)..(519): a, c, t, g, unknown or other
  modified_base (522)..(522): a, c, t, g, unknown or other
  modified_base (531)..(531): a, c, t, g, unknown or other
  modified_base (549)..(549): a, c, t, g, unknown or other
  modified_base (555)..(555): a, c, t, g, unknown or other
  modified_base (561)..(561): a, c, t, g, unknown or other
  modified_base (564)..(564): a, c, t, g, unknown or other
  modified_base (570)..(570): a, c, t, g, unknown or other
  modified_base (573)..(573): a, c, t, g, unknown or other
  modified_base (576)..(576): a, c, t, g, unknown or other
  modified_base (579)..(579): a, c, t, g, unknown or other
  modified_base (582)..(582): a, c, t, g, unknown or other
  modified_base (585)..(585): a, c, t, g, unknown or other
  modified_base (588)..(588): a, c, t, g, unknown or other
  modified_base (591)..(591): a, c, t, g, unknown or other
  modified_base (594)..(594): a, c, t, g, unknown or other
  modified_base (597)..(597): a, c, t, g, unknown or other
  modified_base (600)..(600): a, c, t, g, unknown or other
  modified_base (612)..(612): a, c, t, g, unknown or other
  modified_base (630)..(630): a, c, t, g, unknown or other
  modified_base (639)..(639): a, c, t, g, unknown or other
  modified_base (645)..(645): a, c, t, g, unknown or other
  modified_base (657)..(657): a, c, t, g, unknown or other
  modified_base (660)..(660): a, c, t, g, unknown or other
  modified_base (672)..(672): a, c, t, g, unknown or other
  modified_base (675)..(675): a, c, t, g, unknown or other
  modified_base (693)..(693): a, c, t, g, unknown or other
  modified_base (699)..(699): a, c, t, g, unknown or other
  modified_base (702)..(702): a, c, t, g, unknown or other
  modified_base (711)..(711): a, c, t, g, unknown or other
  modified_base (714)..(714): a, c, t, g, unknown or other
  modified_base (717)..(717): a, c, t, g, unknown or other
  modified_base (729)..(729): a, c, t, g, unknown or other
  modified_base (741)..(741): a, c, t, g, unknown or other
  modified_base (759)..(759): a, c, t, g, unknown or other
  modified_base (762)..(762): a, c, t, g, unknown or other
  modified_base (765)..(765): a, c, t, g, unknown or other
  modified_base (774)..(774): a, c, t, g, unknown or other
  modified_base (780)..(780): a, c, t, g, unknown or other
  modified_base (783)..(783): a, c, t, g, unknown or other
  modified_base (789)..(789): a, c, t, g, unknown or other
  modified_base (795)..(795): a, c, t, g, unknown or other
  modified_base (798)..(798): a, c, t, g, unknown or other
  modified_base (801)..(801): a, c, t, g, unknown or other
  modified_base (804)..(804): a, c, t, g, unknown or other
  modified_base (807)..(807): a, c, t, g, unknown or other
  modified_base (813)..(813): a, c, t, g, unknown or other
  modified_base (816)..(816): a, c, t, g, unknown or other
  modified_base (822)..(822): a, c, t, g, unknown or other
  modified_base (825)..(825): a, c, t, g, unknown or other
  modified_base (828)..(828): a, c, t, g, unknown or other
  modified_base (837)..(837): a, c, t, g, unknown or other
  modified_base (840)..(840): a, c, t, g, unknown or other
  modified_base (846)..(846): a, c, t, g, unknown or other
  modified_base (849)..(849): a, c, t, g, unknown or other
  modified_base (855)..(855): a, c, t, g, unknown or other
  modified_base (858)..(858): a, c, t, g, unknown or other
  modified_base (864)..(864): a, c, t, g, unknown or other
  modified_base (873)..(873): a, c, t, g, unknown or other
  modified_base (879)..(879): a, c, t, g, unknown or other
  modified_base (882)..(882): a, c, t, g, unknown or other
  modified_base (891)..(891): a, c, t, g, unknown or other
  modified_base (900)..(900): a, c, t, g, unknown or other
  modified_base (903)..(903): a, c, t, g, unknown or other
  modified_base (906)..(906): a, c, t, g, unknown or other
  modified_base (909)..(909): a, c, t, g, unknown or other
  modified_base (912)..(912): a, c, t, g, unknown or other
  modified_base (915)..(915): a, c, t, g, unknown or other
  modified_base (921)..(921): a, c, t, g, unknown or other
  modified_base (924)..(924): a, c, t, g, unknown or other
  modified_base (927)..(927): a, c, t, g, unknown or other
  modified_base (933)..(933): a, c, t, g, unknown or other
  modified_base (936)..(936): a, c, t, g, unknown or other
  modified_base (939)..(939): a, c, t, g, unknown or other
  modified_base (945)..(945): a, c, t, g, unknown or other
  modified_base (951)..(951): a, c, t, g, unknown or other
  modified_base (957)..(957): a, c, t, g, unknown or other
  modified_base (960)..(960): a, c, t, g, unknown or other
  modified_base (963)..(963): a, c, t, g, unknown or other
  modified_base (975)..(975): a, c, t, g, unknown or other
  modified_base (987)..(987): a, c, t, g, unknown or other
  modified_base (990)..(990): a, c, t, g, unknown or other
  modified_base (996)..(996): a, c, t, g, unknown or other
  modified_base (1002)..(1002): a, c, t, g, unknown or other
  modified_base (1005)..(1005): a, c, t, g, unknown or other
  modified_base (1008)..(1008): a, c, t, g, unknown or other
  modified_base (1011)..(1011): a, c, t, g, unknown or other
  modified_base (1014)..(1014): a, c, t, g, unknown or other
  modified_base (1020)..(1020): a, c, t, g, unknown or other
  modified_base (1023)..(1023): a, c, t, g, unknown or other
  modified_base (1029)..(1029): a, c, t, g, unknown or other
  modified_base (1035)..(1035): a, c, t, g, unknown or other
  modified_base (1038)..(1038): a, c, t, g, unknown or other
  modified_base (1041)..(1041): a, c, t, g, unknown or other
  modified_base (1044)..(1044): a, c, t, g, unknown or other
  modified_base (1050)..(1050): a, c, t, g, unknown or other
  modified_base (1053)..(1053): a, c, t, g, unknown or other
  modified_base (1062)..(1062): a, c, t, g, unknown or other
  modified_base (1068)..(1068): a, c, t, g, unknown or other
  modified_base (1071)..(1071): a, c, t, g, unknown or other
  modified_base (1083)..(1083): a, c, t, g, unknown or other
  modified_base (1089)..(1089): a, c, t, g, unknown or other
  modified_base (1101)..(1101): a, c, t, g, unknown or other
  modified_base (1110)..(1110): a, c, t, g, unknown or other
  modified_base (1113)..(1113): a, c, t, g, unknown or other
  modified_base (1122)..(1122): a, c, t, g, unknown or other
  modified_base (1131)..(1131): a, c, t, g, unknown or other
  modified_base (1134)..(1134): a, c, t, g, unknown or other
  modified_base (1137)..(1137): a, c, t, g, unknown or other
  modified_base (1143)..(1143): a, c, t, g, unknown or other
ggngcngaygaygtngtngaywsnwsnaarwsnttygtnatggaraayttywsnwsntaycayggnacnaarccnggntaygtngaywsnathcaraarggnathcaraarccnaarwsnggnacncarggnaaytaygaygaygaytggaarggnttygcnwsnacngayaayaartaygaygcngcnggntaywsngtngayaaygaraayccnytnwsnggnaargcnggnggngtngtnaargtnacntayccnggnytnacnaargtnytngcnytnaargtngayaaygcngaracnathaaraargarytnggnytnwsnytnacngarccnytnatggarcargtnggnacngargarttyathaarmgnttyggngayggngcnwsnmgngtngtnytnwsnytnccnttygcngarggnwsnwsnwsngtngcntayathaayaaytgggarcargcnaargcnytnwsngtngarytngarathaayttygaracnmgnggnaarmgnggncargaygcnatgtaygartayatggcncargcntgygcnggnaaymgngtnmgnmgnwsngtnggnwsnwsnytnwsntgyathaayytngaytgggaygarathmgngayaaracnaaracnaarathgarwsnytnaargarcayggnccnathaaraayaaratgwsngarwsnccnaayaaracngtnwsngargaraargcnaarcartayytngargarttycaycaracngcnytngarcayccngarytnwsngarytnaaracngtnacnggnacnaayccngtnttygcnggngcnaaytaygcngcntgggcngtnaaygtngcncargtnathgaywsngaracngcngayaayytngaraaracnacngcngcnytnwsnathytnccnggnathggnwsngtnatgggnathgcngayggngcngtncaycayaayacngargarathgtngcncarwsnathgcnytnwsnwsnytnatggtngcncargcnathccnytngtnggngarytngtngayathggnttygcngcntayaayttygtngarwsnathathaayytnttycargtngtncayaaywsntayaaymgnccngcntaywsn

SEQ ID NO: 44 - DNA, 1164 bp, Artificial Sequence
  source: /note="Description of Artificial Sequence: Synthetic polynucleotide"
  source: /note="DT ribotoxic region polynucleotide variant 3"
  modified_base (3)..(3): a, c, t, g, unknown or other
  modified_base (6)..(6): a, c, t, g, unknown or other
  modified_base (15)..(15): a, c, t, g, unknown or other
  modified_base (18)..(18): a, c, t, g, unknown or other
  modified_base (24)..(24): a, c, t, g, unknown or other
  modified_base (27)..(27): a, c, t, g, unknown or other
  modified_base (33)..(33): a, c, t, g, unknown or other
  modified_base (39)..(39): a, c, t, g, unknown or other
  modified_base (54)..(54): a, c, t, g, unknown or other
  modified_base (57)..(57): a, c, t, g, unknown or other
  modified_base (66)..(66): a, c, t, g, unknown or other
  modified_base (69)..(69): a, c, t, g, unknown or other
  modified_base (75)..(75): a, c, t, g, unknown or other
  modified_base (78)..(78): a, c, t, g, unknown or other
  modified_base (84)..(84): a, c, t, g, unknown or other
  modified_base (90)..(90): a, c, t, g, unknown or other
  modified_base (102)..(102): a, c, t, g, unknown or other
  modified_base (114)..(114): a, c, t, g, unknown or other
  modified_base (120)..(120): a, c, t, g, unknown or other
  modified_base (123)..(123): a, c, t, g, unknown or other
  modified_base (126)..(126): a, c, t, g, unknown or other
  modified_base (132)..(132): a, c, t, g, unknown or other
  modified_base (156)..(156): a, c, t, g, unknown or other
  modified_base (162)..(162): a, c, t, g, unknown or other
  modified_base (165)..(165): a, c, t, g, unknown or other
  modified_base (168)..(168): a, c, t, g, unknown or other
  modified_base (186)..(186): a, c, t, g, unknown or other
  modified_base (189)..(189): a, c, t, g, unknown or other
  modified_base (192)..(192): a, c, t, g, unknown or other
  modified_base (198)..(198): a, c, t, g, unknown or other
  modified_base (201)..(201): a, c, t, g, unknown or other
  modified_base (216)..(216): a, c, t, g, unknown or other
  modified_base (219)..(219): a, c, t, g, unknown or other
  modified_base (222)..(222): a, c, t, g, unknown or other
  modified_base (225)..(225): a, c, t, g, unknown or other
  modified_base (231)..(231): a, c, t, g, unknown or other
  modified_base (234)..(234): a, c, t, g, unknown or other
  modified_base (237)..(237): a, c, t, g, unknown or other
  modified_base (240)..(240): a, c, t, g, unknown or other
  modified_base (243)..(243): a, c, t, g, unknown or other
  modified_base (249)..(249): a, c, t, g, unknown or other
  modified_base (252)..(252): a, c, t, g, unknown or other
  modified_base (258)..(258): a, c, t, g, unknown or other
  modified_base (261)..(261): a, c, t, g, unknown or other
  modified_base (264)..(264): a, c, t, g, unknown or other
  modified_base (267)..(267): a, c, t, g, unknown or other
  modified_base (273)..(273): a, c, t, g, unknown or other
  modified_base (276)..(276): a, c, t, g, unknown or other
  modified_base (279)..(279): a, c, t, g, unknown or other
  modified_base (282)..(282): a, c, t, g, unknown or other
  modified_base (288)..(288): a, c, t, g, unknown or other
  modified_base (297)..(297): a, c, t, g, unknown or other
  modified_base (303)..(303): a, c, t, g, unknown or other
  modified_base (318)..(318): a, c, t, g, unknown or other
  modified_base (321)..(321): a, c, t, g, unknown or other
  modified_base (324)..(324): a, c, t, g, unknown or other
  modified_base (327)..(327): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (342)..(342): a, c, t, g, unknown or other
  modified_base (354)..(354): a, c, t, g, unknown or other
  modified_base (357)..(357): a, c, t, g, unknown or other
  modified_base (360)..(360): a, c, t, g, unknown or other
  modified_base (378)..(378): a, c, t, g, unknown or other
  modified_base (384)..(384): a, c, t, g, unknown or other
  modified_base (390)..(390): a, c, t, g, unknown or other
  modified_base (393)..(393): a, c, t, g, unknown or other
  modified_base (396)..(396): a, c, t, g, unknown or other
  modified_base (399)..(399): a, c, t, g, unknown or other
  modified_base (402)..(402): a, c, t, g, unknown or other
  modified_base (405)..(405): a, c, t, g, unknown or other
  modified_base (408)..(408): a, c, t, g, unknown or other
  modified_base (411)..(411): a, c, t, g, unknown or other
  modified_base (414)..(414): a, c, t, g, unknown or other
  modified_base (417)..(417): a, c, t, g, unknown or other
  modified_base (423)..(423): a, c, t, g, unknown or other
  modified_base (429)..(429): a, c, t, g, unknown or other
  modified_base (432)..(432): a, c, t, g, unknown or other
  modified_base (435)..(435): a, c, t, g, unknown or other
  modified_base (438)..(438): a, c, t, g, unknown or other
  modified_base (441)..(441): a, c, t, g, unknown or other
  modified_base (444)..(444): a, c, t, g, unknown or other
  modified_base (468)..(468): a, c, t, g, unknown or other
  modified_base (474)..(474): a, c, t, g, unknown or other
  modified_base (477)..(477): a, c, t, g, unknown or other
  modified_base (480)..(480): a, c, t, g, unknown or other
  modified_base (483)..(483): a, c, t, g, unknown or other
  modified_base (489)..(489): a, c, t, g, unknown or other
  modified_base (507)..(507): a, c, t, g, unknown or other
  modified_base (510)..(510): a, c, t, g, unknown or other
  modified_base (513)..(513): a, c, t, g, unknown or other
  modified_base (519)..(519): a, c, t, g, unknown or other
  modified_base (522)..(522): a, c, t, g, unknown or other
  modified_base (531)..(531): a, c, t, g, unknown or other
  modified_base (549)..(549): a, c, t, g, unknown or other
  modified_base (555)..(555): a, c, t, g, unknown or other
  modified_base (561)..(561): a, c, t, g, unknown or other
  modified_base (564)..(564): a, c, t, g, unknown or other
  modified_base (570)..(570): a, c, t, g, unknown or other
  modified_base (573)..(573): a, c, t, g, unknown or other
  modified_base (576)..(576): a, c, t, g, unknown or other
  modified_base (579)..(579): a, c, t, g, unknown or other
  modified_base (582)..(582): a, c, t, g, unknown or other
  modified_base (585)..(585): a, c, t, g, unknown or other
  modified_base (588)..(588): a, c, t, g, unknown or other
  modified_base (591)..(591): a, c, t, g, unknown or other
  modified_base (594)..(594): a, c, t, g, unknown or other
  modified_base (597)..(597): a, c, t, g, unknown or other
  modified_base (600)..(600): a, c, t, g, unknown or other
  modified_base (612)..(612): a, c, t, g, unknown or other
  modified_base (624)..(624): a, c, t, g, unknown or other
  modified_base (630)..(630): a, c, t, g, unknown or other
  modified_base (639)..(639): a, c, t, g, unknown or other
  modified_base (645)..(645): a, c, t, g, unknown or other
  modified_base (657)..(657): a, c, t, g, unknown or other
  modified_base (660)..(660): a, c, t, g, unknown or other
  modified_base (672)..(672): a, c, t, g, unknown or other
  modified_base (675)..(675): a, c, t, g, unknown or other
  modified_base (693)..(693): a, c, t, g, unknown or other
  modified_base (699)..(699): a, c, t, g, unknown or other
  modified_base (702)..(702): a, c, t, g, unknown or other
  modified_base (711)..(711): a, c, t, g, unknown or other
  modified_base (714)..(714): a, c, t, g, unknown or other
  modified_base (717)..(717): a, c, t, g, unknown or other
  modified_base (729)..(729): a, c, t, g, unknown or other
  modified_base (741)..(741): a, c, t, g, unknown or other
  modified_base (759)..(759): a, c, t, g, unknown or other
  modified_base (762)..(762): a, c, t, g, unknown or other
  modified_base (765)..(765): a, c, t, g, unknown or other
  modified_base (774)..(774): a, c, t, g, unknown or other
  modified_base (780)..(780): a, c, t, g, unknown or other
  modified_base (783)..(783): a, c, t, g, unknown or other
  modified_base (789)..(789): a, c, t, g, unknown or other
  modified_base (795)..(795): a, c, t, g, unknown or other
  modified_base (798)..(798): a, c, t, g, unknown or other
  modified_base (801)..(801): a, c, t, g, unknown or other
  modified_base (804)..(804): a, c, t, g, unknown or other
  modified_base (807)..(807): a, c, t, g, unknown or other
  modified_base (813)..(813): a, c, t, g, unknown or other
  modified_base (816)..(816): a, c, t, g, unknown or other
  modified_base (822)..(822): a, c, t, g, unknown or other
  modified_base (825)..(825): a, c, t, g, unknown or other
  modified_base (828)..(828): a, c, t, g, unknown or other
  modified_base (837)..(837): a, c, t, g, unknown or other
  modified_base (840)..(840): a, c, t, g, unknown or other
  modified_base (846)..(846): a, c, t, g, unknown or other
  modified_base (849)..(849): a, c, t, g, unknown or other
  modified_base (855)..(855): a, c, t, g, unknown or other
  modified_base (858)..(858): a, c, t, g, unknown or other
  modified_base (864)..(864): a, c, t, g, unknown or other
  modified_base (873)..(873): a, c, t, g, unknown or other
  modified_base (879)..(879): a, c, t, g, unknown or other
  modified_base (882)..(882): a, c, t, g, unknown or other
  modified_base (891)..(891): a, c, t, g, unknown or other
  modified_base (900)..(900): a, c, t, g, unknown or other
  modified_base (903)..(903): a, c, t, g, unknown or other
  modified_base (906)..(906): a, c, t, g, unknown or other
  modified_base (909)..(909): a, c, t, g, unknown or other
  modified_base (912)..(912): a, c, t, g, unknown or other
  modified_base (915)..(915): a, c, t, g, unknown or other
  modified_base (921)..(921): a, c, t, g, unknown or other
  modified_base (924)..(924): a, c, t, g, unknown or other
  modified_base (927)..(927): a, c, t, g, unknown or other
  modified_base (933)..(933): a, c, t, g, unknown or other
  modified_base (936)..(936): a, c, t, g, unknown or other
  modified_base (939)..(939): a, c, t, g, unknown or other
  modified_base (945)..(945): a, c, t, g, unknown or other
  modified_base (951)..(951): a, c, t, g, unknown or other
  modified_base (957)..(957): a, c, t, g, unknown or other
  modified_base (960)..(960): a, c, t, g, unknown or other
  modified_base (963)..(963): a, c, t, g, unknown or other
  modified_base (975)..(975): a, c, t, g, unknown or other
  modified_base (987)..(987): a, c, t, g, unknown or other
  modified_base (990)..(990): a, c, t, g, unknown or other
  modified_base (996)..(996): a, c, t, g, unknown or other
  modified_base (1002)..(1002): a, c, t, g, unknown or other
  modified_base (1005)..(1005): a, c, t, g, unknown or other
  modified_base (1008)..(1008): a, c, t, g, unknown or other
  modified_base (1011)..(1011): a, c, t, g, unknown or other
  modified_base (1014)..(1014): a, c, t, g, unknown or other
  modified_base (1020)..(1020): a, c, t, g, unknown or other
  modified_base (1023)..(1023): a, c, t, g, unknown or other
  modified_base (1029)..(1029): a, c, t, g, unknown or other
  modified_base (1035)..(1035): a, c, t, g, unknown or other
  modified_base (1038)..(1038): a, c, t, g, unknown or other
  modified_base (1041)..(1041): a, c, t, g, unknown or other
  modified_base (1044)..(1044): a, c, t, g, unknown or other
  modified_base (1050)..(1050): a, c, t, g, unknown or other
  modified_base (1053)..(1053): a, c, t, g, unknown or other
  modified_base (1062)..(1062): a, c, t, g, unknown or other
  modified_base (1068)..(1068): a, c, t, g, unknown or other
  modified_base (1071)..(1071): a, c, t, g, unknown or other
  modified_base (1083)..(1083): a, c, t, g, unknown or other
  modified_base (1089)..(1089): a, c, t, g, unknown or other
  modified_base (1101)..(1101): a, c, t, g, unknown or other
  modified_base (1110)..(1110): a, c, t, g, unknown or other
  modified_base (1113)..(1113): a, c, t, g, unknown or other
  modified_base (1122)..(1122): a, c, t, g, unknown or other
  modified_base (1131)..(1131): a, c, t, g, unknown or other
  modified_base (1134)..(1134): a, c, t, g, unknown or other
  modified_base (1137)..(1137): a, c, t, g, unknown or other
  modified_base (1143)..(1143): a, c, t, g, unknown or other
  modified_base (1146)..(1146): a, c, t, g, unknown or other
  modified_base (1149)..(1149): a, c, t, g, unknown or other
  modified_base (1158)..(1158): a, c, t, g, unknown or other
  modified_base (1164)..(1164): a, c, t, g, unknown or other
ggngcngaygaygtngtngaywsnwsnaarwsnttygtnatggaraayttywsnwsntaycayggnacnaarccnggntaygtngaywsnathcaraarggnathcaraarccnaarwsnggnacncarggnaaytaygaygaygaytggaarggnttywsnwsnacngayaayaartaygaygcngcnggntaywsngtngayaaygaraayccnytnwsnggnaargcnggnggngtngtnaargtnacntayccnggnytnacnaargtnytngcnytnaargtngayaaygcngaracnathaaraargarytnggnytnwsnytnacngarccnytnatggarcargtnggnacngargarttyathaarmgnttyggngayggngcnwsnmgngtngtnytnwsnytnccnttygcngarggnwsnwsnwsngtngcntayathaayaaytgggarcargcnaargcnytnwsngtngarytngarathaayttygaracnmgnggnaarmgnggncargaygcnatgtaygartayatggcncargcntgygcnggnaaymgngtnmgnmgnwsngtnggnwsnwsnytnwsntgyathaayytngaytgggaygtnathmgngayaaracnaaracnaarathgarwsnytnaargarcayggnccnathaaraayaaratgwsngarwsnccnaayaaracngtnwsngargaraargcnaarcartayytngargarttycaycaracngcnytngarcayccngarytnwsngarytnaaracngtnacnggnacnaayccngtnttygcnggngcnaaytaygcngcntgggcngtnaaygtngcncargtnathgaywsngaracngcngayaayytngaraaracnacngcngcnytnwsnathytnccnggnathggnwsngtnatgggnathgcngayggngcngtncaycayaayacngargarathgtngcncarwsnathgcnytnwsnwsnytnatggtngcncargcnathccnytngtnggngarytngtngayathggnttygcngcntayaayttygtngarwsnathathaayytnttycargtngtncayaaywsntayaaymgnccngcntaywsnccnggncayaaracncarccn

SEQ ID NO: 45 - DNA, 633 bp, Artificial Sequence
  source: /note="Description of Artificial Sequence: Synthetic polynucleotide"
  source: /note="ricin ribotoxic region polynucleotide variant 1"
  modified_base (6)..(6): a, c, t, g, unknown or other
  modified_base (9)..(9): a, c, t, g, unknown or other
  modified_base (12)..(12): a, c, t, g, unknown or other
  modified_base (15)..(15): a, c, t, g, unknown or other
  modified_base (18)..(18): a, c, t, g, unknown or other
  modified_base (21)..(21): a, c, t, g, unknown or other
  modified_base (24)..(24): a, c, t, g, unknown or other
  modified_base (30)..(30): a, c, t, g, unknown or other
  modified_base (36)..(36): a, c, t, g, unknown or other
  modified_base (48)..(48): a, c, t, g, unknown or other
  modified_base (51)..(51): a, c, t, g, unknown or other
  modified_base (54)..(54): a, c, t, g, unknown or other
  modified_base (57)..(57): a, c, t, g, unknown or other
  modified_base (60)..(60): a, c, t, g, unknown or other
  modified_base (63)..(63): a, c, t, g, unknown or other
  modified_base (66)..(66): a, c, t, g, unknown or other
  modified_base (69)..(69): a, c, t, g, unknown or other
  modified_base (72)..(72): a, c, t, g, unknown or other
  modified_base (75)..(75): a, c, t, g, unknown or other
  modified_base (78)..(78): a, c, t, g, unknown or other
  modified_base (84)..(84): a, c, t, g, unknown or other
  modified_base (87)..(87): a, c, t, g, unknown or other
  modified_base (99)..(99): a, c, t, g, unknown or other
  modified_base (102)..(102): a, c, t, g, unknown or other
  modified_base (105)..(105): a, c, t, g, unknown or other
  modified_base (108)..(108): a, c, t, g, unknown or other
  modified_base (114)..(114): a, c, t, g, unknown or other
  modified_base (117)..(117): a, c, t, g, unknown or other
  modified_base (120)..(120): a, c, t, g, unknown or other
  modified_base (123)..(123): a, c, t, g, unknown or other
  modified_base (126)..(126): a, c, t, g, unknown or other
  modified_base (138)..(138): a, c, t, g, unknown or other
  modified_base (147)..(147): a, c, t, g, unknown or other
  modified_base (150)..(150): a, c, t, g, unknown or other
  modified_base (156)..(156): a, c, t, g, unknown or other
  modified_base (159)..(159): a, c, t, g, unknown or other
  modified_base (168)..(168): a, c, t, g, unknown or other
  modified_base (174)..(174): a, c, t, g, unknown or other
  modified_base (177)..(177): a, c, t, g, unknown or other
  modified_base (180)..(180): a, c, t, g, unknown or other
  modified_base (183)..(183): a, c, t, g, unknown or other
  modified_base (186)..(186): a, c, t, g, unknown or other
  modified_base (189)..(189): a, c, t, g, unknown or other
  modified_base (192)..(192): a, c, t, g, unknown or other
  modified_base (198)..(198): a, c, t, g, unknown or other
  modified_base (201)..(201): a, c, t, g, unknown or other
  modified_base (207)..(207): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (225)..(225): a, c, t, g, unknown or other
  modified_base (228)..(228): a, c, t, g, unknown or other
  modified_base (231)..(231): a, c, t, g, unknown or other
  modified_base (237)..(237): a, c, t, g, unknown or other
  modified_base (240)..(240): a, c, t, g, unknown or other
  modified_base (255)..(255): a, c, t, g, unknown or other
  modified_base (273)..(273): a, c, t, g, unknown or other
  modified_base (279)..(279): a, c, t, g, unknown or other
  modified_base (285)..(285): a, c, t, g, unknown or other
  modified_base (291)..(291): a, c, t, g, unknown or other
  modified_base (297)..(297): a, c, t, g, unknown or other
  modified_base (303)..(303): a, c, t, g, unknown or other
  modified_base (312)..(312): a, c, t, g, unknown or other
  modified_base (318)..(318): a, c, t, g, unknown or other
  modified_base (324)..(324): a, c, t, g, unknown or other
  modified_base (330)..(330): a, c, t, g, unknown or other
  modified_base (333)..(333): a, c, t, g, unknown or other
  modified_base (339)..(339): a, c, t, g, unknown or other
  modified_base (345)..(345): a, c, t, g, unknown or other
  modified_base (348)..(348): a, c, t, g, unknown or other
  modified_base (357)..(357): a, c, t, g, unknown or other
  modified_base (360)..(360): a, c, t, g, unknown or other
  modified_base (363)..(363): a, c, t, g, unknown or other
  modified_base (369)..(369): a, c, t, g, unknown or other
  modified_base (372)..(372): a, c, t, g, unknown or other
  modified_base (387)..(387): a, c, t, g, unknown or other
  modified_base (390)..(390): a, c, t, g, unknown or other
  modified_base (396)..(396): a, c, t, g, unknown or other
  modified_base (399)..(399): a, c, t, g, unknown or other
  modified_base (402)..(402): a, c, t, g, unknown or other
  modified_base (411)..(411): a, c, t, g, unknown or other
  modified_base (417)..(417): a, c, t, g, unknown or other
  modified_base (420)..(420): a, c, t, g, unknown or other
  modified_base (423)..(423): a, c, t, g, unknown or other
  modified_base (435)..(435): a, c, t, g, unknown or other
  modified_base (438)..(438): a, c, t, g, unknown or other
  modified_base (441)..(441): a, c, t, g, unknown or other
  modified_base (444)..(444): a, c, t, g, unknown or other
  modified_base (447)..(447): a, c, t, g, unknown or other
  modified_base (453)..(453): a, c, t, g, unknown or other
  modified_base (456)..(456): a, c, t, g, unknown or other
  modified_base (459)..(459): a, c, t, g, unknown or other
  modified_base (462)..(462): a, c, t, g, unknown or other
  modified_base (465)..(465): a, c, t, g, unknown or other
  modified_base (468)..(468): a, c, t, g, unknown or other
  modified_base (471)..(471): a, c, t, g, unknown or other
  modified_base (498)..(498): a, c, t, g, unknown or other
  modified_base (504)..(504): a, c, t, g, unknown or other
  modified_base (507)..(507): a, c, t, g, unknown or other
  modified_base (510)..(510): a, c, t, g, unknown or other
  modified_base (528)..(528): a, c, t, g, unknown or other
  modified_base (537)..(537): a, c, t, g, unknown or other
  modified_base (540)..(540): a, c, t, g, unknown or other
  modified_base (543)..(543): a, c, t, g, unknown or other
  modified_base (549)..(549): a, c, t, g, unknown or other
  modified_base (558)..(558): a, c, t, g, unknown or other
  modified_base (561)..(561): a, c, t, g, unknown or other
  modified_base (564)..(564): a, c, t, g, unknown or other
  modified_base (567)..(567): a, c, t, g, unknown or other
  modified_base (570)..(570): a, c, t, g, unknown or other
  modified_base (576)..(576): a, c, t, g, unknown or other
  modified_base (579)..(579): a, c, t, g, unknown or other
  modified_base (582)..(582): a, c, t, g, unknown or other
  modified_base (588)..(588): a, c, t, g, unknown or other
  modified_base (591)..(591): a, c, t, g, unknown or other
  modified_base (600)..(600): a, c, t, g, unknown or other
  modified_base (606)..(606): a, c, t, g, unknown or other
  modified_base (609)..(609): a, c, t, g, unknown or other
  modified_base (612)..(612): a, c, t, g, unknown or other
  modified_base (615)..(615): a, c, t, g, unknown or other
  modified_base (618)..(618): a, c, t, g, unknown or other
  modified_base (621)..(621): a, c, t, g, unknown or other
  modified_base (633)..(633): a, c, t, g, unknown or other
ttyacnacngcnggngcnacngtncarwsntayacnaayttyathmgngcngtnmgnggnmgnytnacnacnggngcngaygtnmgncaygarathccngtnytnccnaaymgngtnggnytnccnathaaycarmgnttyathytngtngarytnwsnaaycaygcngarytnwsngtnacnytngcnytngaygtnacnaaygcntaygtngtnggntaymgngcnggnaaywsngcntayttyttycayccngayaaycargargaygcngargcnathacncayytnttyacngaygtncaraaymgntayacnttygcnttyggnggnaaywsngaymgnytngarcarytngcnggnaayytnmgngaraayathgarytnggnaayggnccnytngargargcnathwsngcnytntaytaytaywsnacnggnggnacncarytnccnacnytngcnmgnwsnttyathathtgyathcaratgathwsngaygcngcnmgnttycartayathgarggngaratgmgnacnmgnathmgntayaaymgnmgnwsngcnccngayccnwsngtnathacnytngaraaywsntggggnmgnytnwsnacngcnathcargarwsn

SEQ ID NO: 46 - DNA, 801 bp, Artificial Sequence
  source: /note="Description of Artificial Sequence: Synthetic polynucleotide"
  source: /note="ricin ribotoxic region polynucleotide variant 2"
  modified_base (9)..(9): a, c, t, g, unknown or other
  modified_base (21)..(21): a, c, t, g, unknown or other
  modified_base (36)..(36): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (51)..(51): a, c, t, g, unknown or other
  modified_base (54)..(54): a, c, t, g, unknown or other
  modified_base (60)..(60): a, c, t, g, unknown or other
  modified_base (66)..(66): a, c, t, g, unknown or other
  modified_base (78)..(78): a, c, t, g, unknown or other
  modified_base (81)..(81): a, c, t, g, unknown or other
  modified_base (84)..(84): a, c, t, g, unknown or other
  modified_base (87)..(87): a, c, t, g, unknown or other
  modified_base (90)..(90): a, c, t, g, unknown or other
  modified_base (93)..(93): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (105)..(105): a, c, t, g, unknown or other
  modified_base (108)..(108): a, c, t, g, unknown or other
  modified_base (114)..(114): a, c, t, g, unknown or other
  modified_base (117)..(117): a, c, t, g, unknown or other
  modified_base (129)..(129): a, c, t, g, unknown or other
  modified_base (132)..(132): a, c, t, g, unknown or other
  modified_base (135)..(135): a, c, t, g, unknown or other
  modified_base (138)..(138): a, c, t, g, unknown or other
  modified_base (144)..(144): a, c, t, g, unknown or other
  modified_base (147)..(147): a, c, t, g, unknown or other
  modified_base (150)..(150): a, c, t, g, unknown or other
  modified_base (153)..(153): a, c, t, g, unknown or other
  modified_base (156)..(156): a, c, t, g, unknown or other
  modified_base (168)..(168): a, c, t, g, unknown or other
  modified_base (177)..(177): a, c, t, g, unknown or other
  modified_base (180)..(180): a, c, t, g, unknown or other
  modified_base (186)..(186): a, c, t, g, unknown or other
  modified_base (189)..(189): a, c, t, g, unknown or other
  modified_base (198)..(198): a, c, t, g, unknown or other
  modified_base (204)..(204): a, c, t, g, unknown or other
  modified_base (207)..(207): a, c, t, g, unknown or other
  modified_base (210)..(210): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (222)..(222): a, c, t, g, unknown or other
  modified_base (228)..(228): a, c, t, g, unknown or other
  modified_base (231)..(231): a, c, t, g, unknown or other
  modified_base (237)..(237): a, c, t, g, unknown or other
  modified_base (243)..(243): a, c, t, g, unknown or other
  modified_base (246)..(246): a, c, t, g, unknown or other
  modified_base (249)..(249): a, c, t, g, unknown or other
  modified_base (255)..(255): a, c, t, g, unknown or other
  modified_base (258)..(258): a, c, t, g, unknown or other
  modified_base (261)..(261): a, c, t, g, unknown or other
  modified_base (267)..(267): a, c, t, g, unknown or other
  modified_base (270)..(270): a, c, t, g, unknown or other
  modified_base (285)..(285): a, c, t, g, unknown or other
  modified_base (303)..(303): a, c, t, g, unknown or other
  modified_base (309)..(309): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (333)..(333): a, c, t, g, unknown or other
  modified_base (342)..(342): a, c, t, g, unknown or other
  modified_base (348)..(348): a, c, t, g, unknown or other
  modified_base (354)..(354): a, c, t, g, unknown or other
  modified_base (360)..(360): a, c, t, g, unknown or other
  modified_base (363)..(363): a, c, t, g, unknown or other
  modified_base (369)..(369): a, c, t, g, unknown or other
  modified_base (375)..(375): a, c, t, g, unknown or other
  modified_base (378)..(378): a, c, t, g, unknown or other
  modified_base (387)..(387): a, c, t, g, unknown or other
  modified_base (390)..(390): a, c, t, g, unknown or other
  modified_base (393)..(393): a, c, t, g, unknown or other
  modified_base (399)..(399): a, c, t, g, unknown or other
  modified_base (402)..(402): a, c, t, g, unknown or other
  modified_base (417)..(417): a, c, t, g, unknown or other
  modified_base (420)..(420): a, c, t, g, unknown or other
  modified_base (426)..(426): a, c, t, g, unknown or other
  modified_base (429)..(429): a, c, t, g, unknown or other
  modified_base (432)..(432): a, c, t, g, unknown or other
  modified_base (441)..(441): a, c, t, g, unknown or other
  modified_base (447)..(447): a, c, t, g, unknown or other
  modified_base (450)..(450): a, c, t, g, unknown or other
  modified_base (453)..(453): a, c, t, g, unknown or other
  modified_base (465)..(465): a, c, t, g, unknown or other
  modified_base (468)..(468): a, c, t, g, unknown or other
  modified_base (471)..(471): a, c, t, g, unknown or other
  modified_base (474)..(474): a, c, t, g, unknown or other
  modified_base (477)..(477): a, c, t, g, unknown or other
  modified_base (483)..(483): a, c, t, g, unknown or other
  modified_base (486)..(486): a, c, t, g, unknown or other
  modified_base (489)..(489): a, c, t, g, unknown or other
  modified_base (492)..(492): a, c, t, g, unknown or other
  modified_base (495)..(495): a, c, t, g, unknown or other
  modified_base (498)..(498): a, c, t, g, unknown or other
  modified_base (501)..(501): a, c, t, g, unknown or other
  modified_base (528)..(528): a, c, t, g, unknown or other
  modified_base (534)..(534): a, c, t, g, unknown or other
  modified_base (537)..(537): a, c, t, g, unknown or other
  modified_base (540)..(540): a, c, t, g, unknown or other
  modified_base (558)..(558): a, c, t, g, unknown or other
  modified_base (567)..(567): a, c, t, g, unknown or other
  modified_base (570)..(570): a, c, t, g, unknown or other
  modified_base (573)..(573): a, c, t, g, unknown or other
  modified_base (579)..(579): a, c, t, g, unknown or other
  modified_base (588)..(588): a, c, t, g, unknown or other
  modified_base (591)..(591): a, c, t, g, unknown or other
  modified_base (594)..(594): a, c, t, g, unknown or other
  modified_base (597)..(597): a, c, t, g, unknown or other
  modified_base (600)..(600): a, c, t, g, unknown or other
  modified_base (606)..(606): a, c, t, g, unknown or other
  modified_base (609)..(609): a, c, t, g, unknown or other
  modified_base (612)..(612): a, c, t, g, unknown or other
  modified_base (618)..(618): a, c, t, g, unknown or other
  modified_base (621)..(621): a, c, t, g, unknown or other
  modified_base (630)..(630): a, c, t, g, unknown or other
  modified_base (636)..(636): a, c, t, g, unknown or other
  modified_base (639)..(639): a, c, t, g, unknown or other
  modified_base (642)..(642): a, c, t, g, unknown or other
  modified_base (645)..(645): a, c, t, g, unknown or other
  modified_base (648)..(648): a, c, t, g, unknown or other
  modified_base (651)..(651): a, c, t, g, unknown or other
  modified_base (663)..(663): a, c, t, g, unknown or other
  modified_base (672)..(672): a, c, t, g, unknown or other
  modified_base (675)..(675): a, c, t, g, unknown or other
  modified_base (681)..(681): a, c, t, g, unknown or other
  modified_base (684)..(684): a, c, t, g, unknown or other
  modified_base (687)..(687): a, c, t, g, unknown or other
  modified_base (696)..(696): a, c, t, g, unknown or other
  modified_base (702)..(702): a, c, t, g, unknown or other
  modified_base (705)..(705): a, c, t, g, unknown or other
  modified_base (711)..(711): a, c, t, g, unknown or other
  modified_base (714)..(714): a, c, t, g, unknown or other
  modified_base (723)..(723): a, c, t, g, unknown or other
  modified_base (726)..(726): a, c, t, g, unknown or other
  modified_base (735)..(735): a, c, t, g, unknown or other
  modified_base (738)..(738): a, c, t, g, unknown or other
  modified_base (744)..(744): a, c, t, g, unknown or other
  modified_base (750)..(750): a, c, t, g, unknown or other
  modified_base (759)..(759): a, c, t, g, unknown or other
  modified_base (762)..(762): a, c, t, g, unknown or other
  modified_base (768)..(768): a, c, t, g, unknown or other
  modified_base (774)..(774): a, c, t, g, unknown or other
  modified_base (780)..(780): a, c, t, g, unknown or other
  modified_base (783)..(783): a, c, t, g, unknown or other
  modified_base (786)..(786): a, c, t, g, unknown or other
  modified_base (789)..(789): a, c, t, g, unknown or other
  modified_base (792)..(792): a, c, t, g, unknown or other
  modified_base (795)..(795): a, c, t, g, unknown or other
athttyccnaarcartayccnathathaayttyacnacngcnggngcnacngtncarwsntayacnaayttyathmgngcngtnmgnggnmgnytnacnacnggngcngaygtnmgncaygarathccngtnytnccnaaymgngtnggnytnccnathaaycarmgnttyathytngtngarytnwsnaaycaygcngarytnwsngtnacnytngcnytngaygtnacnaaygcntaygtngtnggntaymgngcnggnaaywsngcntayttyttycayccngayaaycargargaygcngargcnathacncayytnttyacngaygtncaraaymgntayacnttygcnttyggnggnaaygcngaymgnytngarcarytngcnggnaayytnmgngaraayathgarytnggnaayggnccnytngargargcnathwsngcnytntaytaytaywsnacnggnggnacncarytnccnacnytngcnmgnwsnttyathathtgyathcaratgathwsngaygcngcnmgnttycartayathgarggngaratgmgnacnmgnathmgntayaaymgnmgnwsngcnccngayccnwsngtnathacnytngaraaywsntggggnmgnytnwsnacngcnathcargarwsnaaycarggngcnttygcnwsnccnathcarytncarmgnmgnaayggnwsnaarttywsngtntaygaygtnwsnathytnathccnathathgcnytnatggtntaymgntgygcnccnccnccnwsnwsncartty

SEQ ID NO: 47 - DNA, 798 bp, Artificial Sequence
  source: /note="Description of Artificial Sequence: Synthetic polynucleotide"
  source: /note="ricin ribotoxic region polynucleotide variant 3"
  modified_base (3)..(3): a, c, t, g, unknown or other
  modified_base (6)..(6): a, c, t, g, unknown or other
  modified_base (18)..(18): a, c, t, g, unknown or other
  modified_base (33)..(33): a, c, t, g, unknown or other
  modified_base (36)..(36): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (51)..(51): a, c, t, g, unknown or other
  modified_base (57)..(57): a, c, t, g, unknown or other
  modified_base (63)..(63): a, c, t, g, unknown or other
  modified_base (75)..(75): a, c, t, g, unknown or other
  modified_base (78)..(78): a, c, t, g, unknown or other
  modified_base (81)..(81): a, c, t, g, unknown or other
  modified_base (84)..(84): a, c, t, g, unknown or other
  modified_base (87)..(87): a, c, t, g, unknown or other
  modified_base (90)..(90): a, c, t, g, unknown or other
  modified_base (93)..(93): a, c, t, g, unknown or other
  modified_base (96)..(96): a, c, t, g, unknown or other
  modified_base (99)..(99): a, c, t, g, unknown or other
  modified_base (102)..(102): a, c, t, g, unknown or other
  modified_base (105)..(105): a, c, t, g, unknown or other
  modified_base (111)..(111): a, c, t, g, unknown or other
  modified_base (114)..(114): a, c, t, g, unknown or other
  modified_base (126)..(126): a, c, t, g, unknown or other
  modified_base (129)..(129): a, c, t, g, unknown or other
  modified_base (132)..(132): a, c, t, g, unknown or other
  modified_base (135)..(135): a, c, t, g, unknown or other
  modified_base (141)..(141): a, c, t, g, unknown or other
  modified_base (144)..(144): a, c, t, g, unknown or other
  modified_base (147)..(147): a, c, t, g, unknown or other
  modified_base (150)..(150): a, c, t, g, unknown or other
  modified_base (153)..(153): a, c, t, g, unknown or other
  modified_base (165)..(165): a, c, t, g, unknown or other
  modified_base (174)..(174): a, c, t, g, unknown or other
  modified_base (177)..(177): a, c, t, g, unknown or other
  modified_base (183)..(183): a, c, t, g, unknown or other
  modified_base (186)..(186): a, c, t, g, unknown or other
  modified_base (195)..(195): a, c, t, g, unknown or other
  modified_base (201)..(201): a, c, t, g, unknown or other
  modified_base (204)..(204): a, c, t, g, unknown or other
  modified_base (207)..(207): a, c, t, g, unknown or other
  modified_base (210)..(210): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (225)..(225): a, c, t, g, unknown or other
  modified_base (228)..(228): a, c, t, g, unknown or other
  modified_base (234)..(234): a, c, t, g, unknown or other
  modified_base (240)..(240): a, c, t, g, unknown or other
  modified_base (243)..(243): a, c, t, g, unknown or other
  modified_base (246)..(246): a, c, t, g, unknown or other
  modified_base (252)..(252): a, c, t, g, unknown or other
  modified_base (255)..(255): a, c, t, g, unknown or other
  modified_base (258)..(258): a, c, t, g, unknown or other
  modified_base (264)..(264): a, c, t, g, unknown or other
  modified_base (267)..(267): a, c, t, g, unknown or other
  modified_base (282)..(282): a, c, t, g, unknown or other
  modified_base (300)..(300): a, c, t, g, unknown or other
  modified_base (306)..(306): a, c, t, g, unknown or other
  modified_base (312)..(312): a, c, t, g, unknown or other
  modified_base (318)..(318): a, c, t, g, unknown or other
  modified_base (324)..(324): a, c, t, g, unknown or other
  modified_base (330)..(330): a, c, t, g, unknown or other
  modified_base (339)..(339): a, c, t, g, unknown or other
  modified_base (345)..(345): a, c, t, g, unknown or other
  modified_base (351)..(351): a, c, t, g, unknown or other
  modified_base (357)..(357): a, c, t, g, unknown or other
  modified_base (360)..(360): a, c, t, g, unknown or other
  modified_base (366)..(366): a, c, t, g, unknown or other
  modified_base (372)..(372): a, c, t, g, unknown or other
  modified_base (375)..(375): a, c, t, g, unknown or other
  modified_base (384)..(384): a, c, t, g, unknown or other
  modified_base (387)..(387): a, c, t, g, unknown or other
  modified_base (390)..(390): a, c, t, g, unknown or other
  modified_base (396)..(396): a, c, t, g, unknown or other
  modified_base (399)..(399): a, c, t, g, unknown or other
  modified_base (414)..(414): a, c, t, g, unknown or other
  modified_base (417)..(417): a, c, t, g, unknown or other
  modified_base (423)..(423): a, c, t, g, unknown or other
  modified_base (426)..(426): a, c, t, g, unknown or other
  modified_base (429)..(429): a, c, t, g, unknown or other
  modified_base (438)..(438): a, c, t, g, unknown or other
  modified_base (444)..(444): a, c, t, g, unknown or other
  modified_base (447)..(447): a, c, t, g, unknown or other
  modified_base (450)..(450): a, c, t, g, unknown or other
  modified_base (462)..(462): a, c, t, g, unknown or other
  modified_base (465)..(465): a, c, t, g, unknown or other
  modified_base (468)..(468): a, c, t, g, unknown or other
  modified_base (471)..(471): a, c, t, g, unknown or other
  modified_base (474)..(474): a, c, t, g, unknown or other
  modified_base (480)..(480): a, c, t, g, unknown or other
  modified_base (483)..(483): a, c, t, g, unknown or other
  modified_base (486)..(486): a, c, t, g, unknown or other
  modified_base (489)..(489): a, c, t, g, unknown or other
  modified_base (492)..(492): a, c, t, g, unknown or other
  modified_base (495)..(495): a, c, t, g, unknown or other
  modified_base (498)..(498): a, c, t, g, unknown or other
  modified_base (525)..(525): a, c, t, g, unknown or other
  modified_base (528)..(528): a, c, t, g, unknown or other
  modified_base (531)..(531): a, c, t, g, unknown or other
  modified_base (534)..(534): a, c, t, g, unknown or other
  modified_base (537)..(537): a, c, t, g, unknown or other
  modified_base (555)..(555): a, c, t, g, unknown or other
  modified_base (564)..(564): a, c, t, g, unknown or other
  modified_base (567)..(567): a, c, t, g, unknown or other
  modified_base (570)..(570): a, c, t, g, unknown or other
  modified_base (576)..(576): a, c, t, g, unknown or other
  modified_base (585)..(585): a, c, t, g, unknown or other
  modified_base (588)..(588): a, c, t, g, unknown or other
  modified_base (591)..(591): a, c, t, g, unknown or other
  modified_base (594)..(594): a, c, t, g, unknown or other
  modified_base (597)..(597): a, c, t, g, unknown or other
  modified_base (603)..(603): a, c, t, g, unknown or other
  modified_base (606)..(606): a, c, t, g, unknown or other
  modified_base (609)..(609): a, c, t, g, unknown or other
  modified_base (615)..(615): a, c, t, g, unknown or other
  modified_base (618)..(618): a, c, t, g, unknown or other
  modified_base (627)..(627): a, c, t, g, unknown or other
  modified_base (633)..(633): a, c, t, g, unknown or other
  modified_base (636)..(636): a, c, t, g, unknown or other
  modified_base (639)..(639): a, c, t, g, unknown or other
  modified_base (642)..(642): a, c, t, g, unknown or other
  modified_base (645)..(645): a, c, t, g, unknown or other
  modified_base (648)..(648): a, c, t, g, unknown or other
  modified_base (660)..(660): a, c, t, g, unknown or other
  modified_base (669)..(669): a, c, t, g, unknown or other
  modified_base (672)..(672): a, c, t, g, unknown or other
  modified_base (678)..(678): a, c, t, g, unknown or other
  modified_base (681)..(681): a, c, t, g, unknown or other
  modified_base (684)..(684): a, c, t, g, unknown or other
  modified_base (693)..(693): a, c, t, g, unknown or other
  modified_base (699)..(699): a, c, t, g, unknown or other
  modified_base (702)..(702): a, c, t, g, unknown or other
  modified_base (708)..(708): a, c, t, g, unknown or other
  modified_base (711)..(711): a, c, t, g, unknown or other
  modified_base (720)..(720): a, c, t, g, unknown or other
  modified_base (723)..(723): a, c, t, g, unknown or other
  modified_base (732)..(732): a, c, t, g, unknown or other
  modified_base (735)..(735): a, c, t, g, unknown or other
  modified_base (741)..(741): a, c, t, g, unknown or other
  modified_base (747)..(747): a, c, t, g, unknown or other
  modified_base (756)..(756): a, c, t, g, unknown or other
  modified_base (759)..(759): a, c, t, g, unknown or other
  modified_base (765)..(765): a, c, t, g, unknown or other
  modified_base (771)..(771): a, c, t, g, unknown or other
  modified_base (777)..(777): a, c, t, g, unknown or other
  modified_base (780)..(780): a, c, t, g, unknown or other
  modified_base (783)..(783): a, c, t, g, unknown or other
  modified_base (786)..(786): a, c, t, g, unknown or other
  modified_base (789)..(789): a, c, t, g, unknown or other
  modified_base (792)..(792): a, c, t, g, unknown or other
gtnccnaarcartayccnathathaayttyacnacngcnggngcnacngtncarwsntayacnaayttyathmgngcngtnmgnggnmgnytnacnacnggngcngaygtnmgncaygarathccngtnytnccnaaymgngtnggnytnccnathaaycarmgnttyathytngtngarytnwsnaaycaygcngarytnwsngtnacnytngcnytngaygtnacnaaygcntaygtngtnggntaymgngcnggnaaywsngcntayttyttycayccngayaaycargargaygcngargcnathacncayytnttyacngaygtncaraaymgntayacnttygcnttyggnggnaaywsngaymgnytngarcarytngcnggnaayytnmgngaraayathgarytnggnaayggnccnytngargargcnathwsngcnytntaytaytaywsnacnggnggnacncarytnccnacnytngcnmgnwsnttyathathtgyathcaratgathwsngcngcngcnmgnttycartayathgarggngaratgmgnacnmgnathmgntayaaymgnmgnwsngcnccngayccnwsngtnathacnytngaraaywsntggggnmgnytnwsnacngcnathcargarwsnaaycarggngcnttygcnwsnccnathcarytncarmgnmgnaayggnwsnaarttywsngtntaygaygtnwsnathytnathccnathathgcnytnatggtntaymgntgygcnccnccnccnwsnwsncartty

SEQ ID NO: 48 - DNA, 384 bp, Artificial Sequence
  source: /note="Description of Artificial Sequence: Synthetic polynucleotide"
  source: /note="sarcin ribotoxic region polynucleotide variant 1"
  modified_base (3)..(3): a, c, t, g, unknown or other
  modified_base (6)..(6): a, c, t, g, unknown or other
  modified_base (9)..(9): a, c, t, g, unknown or other
  modified_base (27)..(27): a, c, t, g, unknown or other
  modified_base (33)..(33): a, c, t, g, unknown or other
  modified_base (39)..(39): a, c, t, g, unknown or other
  modified_base (48)..(48): a, c, t, g, unknown or other
  modified_base (51)..(51): a, c, t, g, unknown or other
  modified_base (54)..(54): a, c, t, g, unknown or other
  modified_base (57)..(57): a, c, t, g, unknown or other
  modified_base (63)..(63): a, c, t, g, unknown or other
  modified_base (69)..(69): a, c, t, g, unknown or other
  modified_base (72)..(72): a, c, t, g, unknown or other
  modified_base (75)..(75): a, c, t, g, unknown or other
  modified_base (78)..(78): a, c, t, g, unknown or other
  modified_base (84)..(84): a, c, t, g, unknown or other
  modified_base (87)..(87): a, c, t, g, unknown or other
  modified_base (96)..(96): a, c, t, g, unknown or other
  modified_base (102)..(102): a, c, t, g, unknown or other
  modified_base (111)..(111): a, c, t, g, unknown or other
  modified_base (117)..(117): a, c, t, g, unknown or other
  modified_base (123)..(123): a, c, t, g, unknown or other
  modified_base (126)..(126): a, c, t, g, unknown or other
  modified_base (132)..(132): a, c, t, g, unknown or other
  modified_base (135)..(135): a, c, t, g, unknown or other
  modified_base (138)..(138): a, c, t, g, unknown or other
  modified_base (141)..(141): a, c, t, g, unknown or other
  modified_base (153)..(153): a, c, t, g, unknown or other
  modified_base (159)..(159): a, c, t, g, unknown or other
  modified_base (171)..(171): a, c, t, g, unknown or other
  modified_base (174)..(174): a, c, t, g, unknown or other
  modified_base (177)..(177): a, c, t, g, unknown or other
  modified_base (186)..(186): a, c, t, g, unknown or other
  modified_base (195)..(195): a, c, t, g, unknown or other
  modified_base (201)..(201): a, c, t, g, unknown or other
  modified_base (207)..(207): a, c, t, g, unknown or other
  modified_base (219)..(219): a, c, t, g, unknown or other
  modified_base (222)..(222): a, c, t, g, unknown or other
  modified_base (225)..(225): a, c, t, g, unknown or other
  modified_base (231)..(231): a, c, t, g, unknown or other
  modified_base (234)..(234): a, c, t, g, unknown or other
  modified_base (240)..(240): a, c, t, g, unknown or other
  modified_base (246)..(246): a, c, t, g, unknown or other
  modified_base (267)..(267): a, c, t, g, unknown or other
  modified_base (276)..(276): a, c, t, g, unknown or other
  modified_base (288)..(288): a, c, t, g, unknown or other
  modified_base (291)..(291): a, c, t, g, unknown or other
  modified_base (294)..(294): a, c, t, g, unknown or other
  modified_base (297)..(297): a, c, t, g, unknown or other
  modified_base (300)..(300): a, c, t, g, unknown or other
  modified_base (303)..(303): a, c, t, g, unknown or other
  modified_base (312)..(312): a, c, t, g, unknown or other
  modified_base (318)..(318): a, c, t, g, unknown or other
  modified_base (327)..(327): a, c, t, g, unknown or other
  modified_base (336)..(336): a, c, t, g, unknown or other
  modified_base (345)..(345): a, c, t, g, unknown or other
  modified_base (351)..(351): a, c, t, g, unknown or other
  modified_base (366)..(366): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
mgnytnytntayaaycaraayaargcngarwsnaaywsncaycaygcnccnytnwsngayggnaaracnggnwsnwsntayccngcntggttyacnaayggntaygayggngayggnaarytnccnaarggnmgnacnccnathaarttyggnaarwsngaytgygaymgnccnccnaarcaywsnaargayggnaayggnaaracngaycaytayytnytngcnttyccnacnttyccngayggncaygaytayaarttygaywsnaaraarccnaargaraayccnggnccngcnmgngtnathtayacntayccnaayaargtnttytgyggnathathgcncayacnaargaraaycarggngarytnaarytntgywsn

SEQ ID NO: 49 - DNA, 450 bp, Artificial Sequence
  source: /note="Description of Artificial Sequence: Synthetic polynucleotide"
  source: /note="sarcin ribotoxic region polynucleotide variant 2"
  modified_base (3)..(3): a, c, t, g, unknown or other
  modified_base (6)..(6): a, c, t, g, unknown or other
  modified_base (9)..(9): a, c, t, g, unknown or other
  modified_base (15)..(15): a, c, t, g, unknown or other
  modified_base (21)..(21): a, c, t, g, unknown or other
  modified_base (39)..(39): a, c, t, g, unknown or other
  modified_base (45)..(45): a, c, t, g, unknown or other
  modified_base (60)..(60): a, c, t, g, unknown or other
  modified_base (66)..(66): a, c, t, g, unknown or other
  modified_base (69)..(69): a, c, t, g, unknown or other
  modified_base (72)..(72): a, c, t, g, unknown or other
  modified_base (90)..(90): a, c, t, g, unknown or other
  modified_base (96)..(96): a, c, t, g, unknown or other
  modified_base (102)..(102): a, c, t, g, unknown or other
  modified_base (111)..(111): a, c, t, g, unknown or other
  modified_base (114)..(114): a, c, t, g, unknown or other
  modified_base (117)..(117): a, c, t, g, unknown or other
  modified_base (120)..(120): a, c, t, g, unknown or other
  modified_base (126)..(126): a, c, t, g, unknown or other
  modified_base (132)..(132): a, c, t, g, unknown or other
  modified_base (135)..(135): a, c, t, g, unknown or other
  modified_base (138)..(138): a, c, t, g, unknown or other
  modified_base (141)..(141): a, c, t, g, unknown or other
  modified_base (147)..(147): a, c, t, g, unknown or other
  modified_base (150)..(150): a, c, t, g, unknown or other
  modified_base (159)..(159): a, c, t, g, unknown or other
  modified_base (165)..(165): a, c, t, g, unknown or other
  modified_base (174)..(174): a, c, t, g, unknown or other
  modified_base (180)..(180): a, c, t, g, unknown or other
  modified_base (186)..(186): a, c, t, g, unknown or other
  modified_base (189)..(189): a, c, t, g, unknown or other
  modified_base (195)..(195): a, c, t, g, unknown or other
  modified_base (198)..(198): a, c, t, g, unknown or other
  modified_base (201)..(201): a, c, t, g, unknown or other
  modified_base (204)..(204): a, c, t, g, unknown or other
  modified_base (216)..(216): a, c, t, g, unknown or other
  modified_base (222)..(222): a, c, t, g, unknown or other
  modified_base (234)..(234): a, c, t, g, unknown or other
  modified_base (237)..(237): a, c, t, g, unknown or other
  modified_base (240)..(240): a, c, t, g, unknown or other
  modified_base (249)..(249): a, c, t, g, unknown or other
  modified_base (258)..(258): a, c, t, g, unknown or other
  modified_base (264)..(264): a, c, t, g, unknown or other
  modified_base (270)..(270): a, c, t, g, unknown or other
  modified_base (282)..(282): a, c, t, g, unknown or other
  modified_base (285)..(285): a, c, t, g, unknown or other
  modified_base (288)..(288): a, c, t, g, unknown or other
  modified_base (294)..(294): a, c, t, g, unknown or other
  modified_base (297)..(297): a, c, t, g, unknown or other
  modified_base (303)..(303): a, c, t, g, unknown or other
  modified_base (309)..(309): a, c, t, g, unknown or other
  modified_base (330)..(330): a, c, t, g, unknown or other
  modified_base (339)..(339): a, c, t, g, unknown or other
  modified_base (351)..(351): a, c, t, g, unknown or other
  modified_base (354)..(354): a, c, t, g, unknown or other
  modified_base (357)..(357): a, c, t, g, unknown or other
  modified_base (360)..(360): a, c, t, g, unknown or other
  modified_base (363)..(363): a, c, t, g, unknown or other
  modified_base (366)..(366): a, c, t, g, unknown or other
  modified_base (375)..(375): a, c, t, g, unknown or other
  modified_base (381)..(381): a, c, t, g, unknown or other
  modified_base (390)..(390): a, c, t, g, unknown or other
  modified_base (399)..(399): a, c, t, g, unknown or other
  modified_base (408)..(408): a, c, t, g, unknown or other
  modified_base (414)..(414): a, c, t, g, unknown or other
  modified_base (429)..(429): a, c, t, g, unknown or other
  modified_base (435)..(435): a, c, t, g, unknown or other
  modified_base (441)..(441): a, c, t, g, unknown or other
  modified_base (447)..(447): a, c, t, g, unknown or other
gcngtnacntggacntgyytnaaygaycaraaraayccnaaracnaayaartaygaracnaarmgnytnytntayaaycaraayaargcngarwsnaaywsncaycaygcnccnytnwsngayggnaaracnggnwsnwsntayccngcntggttyacnaayggntaygayggngayggnaarytnccnaarggnmgnacnccnathaarttyggnaarwsngaytgygaymgnccnccnaarcaywsnaargayggnaayggnaaracngaycaytayytnytngcnttyccnacnttyccngayggncaygaytayaarttygaywsnaaraarccnaargaraayccnggnccngcnmgngtnathtayacntayccnaayaargtnttytgyggnathathgcncayacnaargaraaycarggngarytnaarytntgywsncay

SEQ ID NO: 50 - DNA, 1041 bp, Artificial Sequence
  source: /note="Description of Artificial Sequence: Synthetic polynucleotide"
  source: /note="PE ribotoxic region polynucleotide variant 1"
  modified_base (3)..(3): a, c, t, g, unknown or other
  modified_base (9)..(9): a, c, t, g, unknown or other
  modified_base (12)..(12): a, c, t, g, unknown or other
  modified_base (15)..(15): a, c, t, g, unknown or other
  modified_base (18)..(18): a, c, t, g, unknown or other
  modified_base (21)..(21): a, c, t, g, unknown or other
  modified_base (24)..(24): a, c, t, g, unknown or other
  modified_base (27)..(27): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (51)..(51): a, c, t, g, unknown or other
  modified_base (54)..(54): a, c, t, g, unknown or other
  modified_base (57)..(57): a, c, t, g, unknown or other
  modified_base (63)..(63): a, c, t, g, unknown or other
  modified_base (69)..(69): a, c, t, g, unknown or other
  modified_base (72)..(72): a, c, t, g, unknown or other
  modified_base (78)..(78): a, c, t, g, unknown or other
  modified_base (84)..(84): a, c, t, g, unknown or other
  modified_base (87)..(87): a, c, t, g, unknown or other
  modified_base (90)..(90): a, c, t, g, unknown or other
  modified_base (102)..(102): a, c, t, g, unknown or other
  modified_base (114)..(114): a, c, t, g, unknown or other
  modified_base (120)..(120): a, c, t, g, unknown or other
  modified_base (123)..(123): a, c, t, g, unknown or other
  modified_base (129)..(129): a, c, t, g, unknown or other
  modified_base (132)..(132): a, c, t, g, unknown or other
  modified_base (135)..(135): a, c, t, g, unknown or other
  modified_base (138)..(138): a, c, t, g, unknown or other
  modified_base (141)..(141): a, c, t, g, unknown or other
  modified_base (147)..(147): a, c, t, g, unknown or other
  modified_base (150)..(150): a, c, t, g, unknown or other
  modified_base (153)..(153): a, c, t, g, unknown or other
  modified_base (156)..(156): a, c, t, g, unknown or other
  modified_base (159)..(159): a, c, t, g, unknown or other
  modified_base (162)..(162): a, c, t, g, unknown or other
  modified_base (174)..(174): a, c, t, g, unknown or other
  modified_base (183)..(183): a, c, t, g, unknown or other
  modified_base (189)..(189): a, c, t, g, unknown or other
  modified_base (195)..(195): a, c, t, g, unknown or other
  modified_base (198)..(198): a, c, t, g, unknown or other
  modified_base (201)..(201): a, c, t, g, unknown or other
  modified_base (204)..(204): a, c, t, g, unknown or other
  modified_base (207)..(207): a, c, t, g, unknown or other
  modified_base (210)..(210): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (225)..(225): a, c, t, g, unknown or other
  modified_base (228)..(228): a, c, t, g, unknown or other
  modified_base (234)..(234): a, c, t, g, unknown or other
  modified_base (240)..(240): a, c, t, g, unknown or other
  modified_base (249)..(249): a, c, t, g, unknown or other
  modified_base (258)..(258): a, c, t, g, unknown or other
  modified_base (261)..(261): a, c, t, g, unknown or other
  modified_base (264)..(264): a, c, t, g, unknown or other
  modified_base (267)..(267): a, c, t, g, unknown or other
  modified_base (270)..(270): a, c, t, g, unknown or other
  modified_base (273)..(273): a, c, t, g, unknown or other
  modified_base (276)..(276): a, c, t, g, unknown or other
  modified_base (279)..(279): a, c, t, g, unknown or other
  modified_base (282)..(282): a, c, t, g, unknown or other
  modified_base (285)..(285): a, c, t, g, unknown or other
  modified_base (291)..(291): a, c, t, g, unknown or other
  modified_base (297)..(297): a, c, t, g, unknown or other
  modified_base (303)..(303): a, c, t, g, unknown or other
  modified_base (306)..(306): a, c, t, g, unknown or other
  modified_base (312)..(312): a, c, t, g, unknown or other
  modified_base (315)..(315): a, c, t, g, unknown or other
  modified_base (318)..(318): a, c, t, g, unknown or other
  modified_base (330)..(330): a, c, t, g, unknown or other
  modified_base (333)..(333): a, c, t, g, unknown or other
  modified_base (336)..(336): a, c, t, g, unknown or other
  modified_base (339)..(339): a, c, t, g, unknown or other
  modified_base (345)..(345): a, c, t, g, unknown or other
  modified_base (348)..(348): a, c, t, g, unknown or other
  modified_base (351)..(351): a, c, t, g, unknown or other
  modified_base (357)..(357): a, c, t, g, unknown or other
  modified_base (360)..(360): a, c, t, g, unknown or other
  modified_base (366)..(366): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (387)..(387): a, c, t, g, unknown or other
  modified_base (390)..(390): a, c, t, g, unknown or other
  modified_base (393)..(393): a, c, t, g, unknown or other
  modified_base (396)..(396): a, c, t, g, unknown or other
  modified_base (405)..(405): a, c, t, g, unknown or other
  modified_base (408)..(408): a, c, t, g, unknown or other
  modified_base (414)..(414): a, c, t, g, unknown or other
  modified_base (417)..(417): a, c, t, g, unknown or other
  modified_base (423)..(423): a, c, t, g, unknown or other
  modified_base (426)..(426): a, c, t, g, unknown or other
  modified_base (432)..(432): a, c, t, g, unknown or other
  modified_base (435)..(435): a, c, t, g, unknown or other
  modified_base (438)..(438): a, c, t, g, unknown or other
  modified_base (441)..(441): a, c, t, g, unknown or other
  modified_base (444)..(444): a, c, t, g, unknown or other
  modified_base (456)..(456): a, c, t, g, unknown or other
  modified_base (459)..(459): a, c, t, g, unknown or other
  modified_base (465)..(465): a, c, t, g, unknown or other
  modified_base (468)..(468): a, c, t, g, unknown or other
  modified_base (471)..(471): a, c, t, g, unknown or other
  modified_base (477)..(477): a, c, t, g, unknown or other
  modified_base (483)..(483): a, c, t, g, unknown or other
  modified_base (489)..(489): a, c, t, g, unknown or other
  modified_base (498)..(498): a, c, t, g, unknown or other
  modified_base (501)..(501): a, c, t, g, unknown or other
  modified_base (507)..(507): a, c, t, g, unknown or other
  modified_base (513)..(513): a, c, t, g, unknown or other
  modified_base (516)..(516): a, c, t, g, unknown or other
  modified_base (525)..(525): a, c, t, g, unknown or other
  modified_base (528)..(528): a, c, t, g, unknown or other
  modified_base (534)..(534): a, c, t, g, unknown or other
  modified_base (540)..(540): a, c, t, g, unknown or other
  modified_base (543)..(543): a, c, t, g, unknown or other
  modified_base (549)..(549): a, c, t, g, unknown or other
  modified_base (555)..(555): a, c, t, g, unknown or other
  modified_base (561)..(561): a, c, t, g, unknown or other
  modified_base (564)..(564): a, c, t, g, unknown or other
  modified_base (567)..(567): a, c, t, g, unknown or other
  modified_base (570)..(570): a, c, t, g, unknown or other
  modified_base (573)..(573): a, c, t, g, unknown or other
  modified_base (576)..(576): a, c, t, g, unknown or other
  modified_base (579)..(579): a, c, t, g, unknown or other
  modified_base (588)..(588): a, c, t, g, unknown or other
  modified_base (594)..(594): a, c, t, g, unknown or other
  modified_base (603)..(603): a, c, t, g, unknown or other
  modified_base (606)..(606): a, c, t, g, unknown or other
  modified_base (618)..(618): a, c, t, g, unknown or other
  modified_base (621)..(621): a, c, t, g, unknown or other
  modified_base (627)..(627): a, c, t, g, unknown or other
  modified_base (630)..(630): a, c, t, g, unknown or other
  modified_base (633)..(633): a, c, t, g, unknown or other
  modified_base (636)..(636): a, c, t, g, unknown or other
  modified_base (642)..(642): a, c, t, g, unknown or other
  modified_base (648)..(648): a, c, t, g, unknown or other
  modified_base (663)..(663): a, c, t, g, unknown or other
  modified_base (669)..(669): a, c, t, g, unknown or other
  modified_base (672)..(672): a, c, t, g, unknown or other
  modified_base (675)..(675): a, c, t, g, unknown or other
  modified_base (678)..(678): a, c, t, g, unknown or other
  modified_base (684)..(684): a, c, t, g, unknown or other
  modified_base (690)..(690): a, c, t, g, unknown or other
  modified_base (693)..(693): a, c, t, g, unknown or other
  modified_base (696)..(696): a, c, t, g, unknown or other
  modified_base (699)..(699): a, c, t, g, unknown or other
  modified_base (702)..(702): a, c, t, g, unknown or other
  modified_base (705)..(705): a, c, t, g, unknown or other
  modified_base (711)..(711): a, c, t, g, unknown or other
  modified_base (714)..(714): a, c, t, g, unknown or other
  modified_base (717)..(717): a, c, t, g, unknown or other
  modified_base (720)..(720): a, c, t, g, unknown or other
  modified_base (723)..(723): a, c, t, g, unknown or other
  modified_base (726)..(726): a, c, t, g, unknown or other
  modified_base (729)..(729): a, c, t, g, unknown or other
  modified_base (732)..(732): a, c, t, g, unknown or other
  modified_base (741)..(741): a, c, t, g, unknown or other
  modified_base (744)..(744): a, c, t, g, unknown or other
  modified_base (747)..(747): a, c, t, g, unknown or other
  modified_base (750)..(750): a, c, t, g, unknown or other
  modified_base (753)..(753): a, c, t, g, unknown or other
  modified_base (756)..(756): a, c, t, g, unknown or other
  modified_base (759)..(759): a, c, t, g, unknown or other
  modified_base (762)..(762): a, c, t, g, unknown or other
  modified_base (765)..(765): a, c, t, g, unknown or other
  modified_base (771)..(771): a, c, t, g, unknown or other
  modified_base (774)..(774): a, c, t, g, unknown or other
  modified_base (777)..(777): a, c, t, g, unknown or other
  modified_base (783)..(783): a, c, t, g, unknown or other
  modified_base (789)..(789): a, c, t, g, unknown or other
  modified_base (792)..(792): a, c, t, g, unknown or other
  modified_base (798)..(798): a, c, t, g, unknown or other
  modified_base (804)..(804): a, c, t, g, unknown or other
  modified_base (807)..(807): a, c, t, g, unknown or other
  modified_base (810)..(810): a, c, t, g, unknown or other
  modified_base (813)..(813): a, c, t, g, unknown or other
  modified_base (816)..(816): a, c, t, g, unknown or other
  modified_base (819)..(819): a, c, t, g, unknown or other
  modified_base (825)..(825): a, c, t, g, unknown or other
  modified_base (831)..(831): a, c, t, g, unknown or other
  modified_base (834)..(834): a, c, t, g, unknown or other
  modified_base (837)..(837): a, c, t, g, unknown or other
  modified_base (849)..(849): a, c, t, g, unknown or other
  modified_base (852)..(852): a, c, t, g, unknown or other
  modified_base (855)..(855): a, c, t, g, unknown or other
  modified_base (858)..(858): a, c, t, g, unknown or other
  modified_base (861)..(861): a, c, t, g, unknown or other
  modified_base (864)..(864): a, c, t, g, unknown or other
  modified_base (870)..(870): a, c, t, g, unknown or other
  modified_base (873)..(873): a, c, t, g, unknown or other
  modified_base (879)..(879): a, c, t, g, unknown or other
  modified_base (882)..(882): a, c, t, g, unknown or other
  modified_base (885)..(885): a, c, t, g, unknown or other
  modified_base (891)..(891): a, c, t, g, unknown or other
  modified_base (894)..(894): a, c, t, g, unknown or other
  modified_base (897)..(897): a, c, t, g, unknown or other
  modified_base (900)..(900): a, c, t, g, unknown or other
  modified_base (906)..(906): a, c, t, g, unknown or other
  modified_base (909)..(909): a, c, t, g, unknown or other
  modified_base (912)..(912): a, c, t, g, unknown or other
  modified_base (918)..(918): a, c, t, g, unknown or other
  modified_base (921)..(921): a, c, t, g, unknown or other
  modified_base (927)..(927): a, c, t, g, unknown or other
  modified_base (930)..(930): a, c, t, g, unknown or other
  modified_base (936)..(936): a, c, t, g, unknown or other
  modified_base (939)..(939): a, c, t, g, unknown or other
  modified_base (942)..(942): a, c, t, g, unknown or other
  modified_base (948)..(948): a, c, t, g, unknown or other
  modified_base (954)..(954): a, c, t, g, unknown or other
  modified_base (957)..(957): a, c, t, g, unknown or other
  modified_base (960)..(960): a, c, t, g, unknown or other
  modified_base (966)..(966): a, c, t, g, unknown or other
  modified_base (981)..(981): a, c, t, g, unknown or other
  modified_base (987)..(987): a, c, t, g, unknown or other
  modified_base (990)..(990): a, c, t, g, unknown or other
  modified_base (993)..(993): a, c, t, g, unknown or other
  modified_base (996)..(996): a, c, t, g, unknown or other
  modified_base (1005)..(1005): a, c, t, g, unknown or other
  modified_base (1008)..(1008): a, c, t, g, unknown or other
  modified_base (1014)..(1014): a, c, t, g, unknown or other
  modified_base (1017)..(1017): a, c, t, g, unknown or other
  modified_base (1023)..(1023): a, c, t, g, unknown or other
  modified_base (1026)..(1026): a, c, t, g, unknown or other
  modified_base (1029)..(1029): a, c, t, g, unknown or other
  modified_base (1038)..(1038): a, c, t, g, unknown or other
ccngarggnggnwsnytngcngcnytnacngcncaycargcntgycayytnccnytngaracnttyacnmgncaymgncarccnmgnggntgggarcarytngarcartgyggntayccngtncarmgnytngtngcnytntayytngcngcnmgnytnwsntggaaycargtngaycargtnathmgnaaygcnytngcnwsnccnggnwsnggnggngayytnggngargcnathmgngarcarccngarcargcnmgnytngcnytnacnytngcngcngcngarwsngarmgnttygtnmgncarggnacnggnaaygaygargcnggngcngcnaayggnccngcngaywsnggngaygcnytnytngarmgnaaytayccnacnggngcngarttyytnggngayggnggngaygtnwsnttywsnacnmgnggnacncaraaytggacngtngarmgnytnytncargcncaymgncarytngargarmgnggntaygtnttygtnggntaycayggnacnttyytngargcngcncarwsnathgtnttyggnggngtnmgngcnmgnwsncargayytngaygcnathtggmgnggnttytayathgcnggngayccngcnytngcntayggntaygcncargaycargarccngaygcnmgnggnmgnathmgnaayggngcnytnytnmgngtntaygtnccnmgnwsnwsnytnccnggnttytaymgnacnwsnytnacnytngcngcnccngargcngcnggngargtngarmgnytnathggncayccnytnccnytnmgnytngaygcnathacnggnccngargargarggnggngcnytngcnacnathytnggntggccnytngcngarmgnacngtngtnathccnwsngcnathccnacngayccnmgnaaygtnggnggngayytngayccnwsnwsnathccngayaargarcargcnathwsngcnytnccngaytaygcnwsncarccnggnaarccnccnmgngargayytnaar

SEQ ID NO: 51 - DNA, 1434 bp, Artificial Sequence
  source: /note="Description of Artificial Sequence: Synthetic polynucleotide"
  source: /note="PE ribotoxic region polynucleotide variant 2"
  modified_base (3)..(3): a, c, t, g, unknown or other
  modified_base (6)..(6): a, c, t, g, unknown or other
  modified_base (9)..(9): a, c, t, g, unknown or other
  modified_base (12)..(12): a, c, t, g, unknown or other
  modified_base (15)..(15): a, c, t, g, unknown or other
  modified_base (18)..(18): a, c, t, g, unknown or other
  modified_base (36)..(36): a, c, t, g, unknown or other
  modified_base (42)..(42): a, c, t, g, unknown or other
  modified_base (48)..(48): a, c, t, g, unknown or other
  modified_base (66)..(66): a, c, t, g, unknown or other
  modified_base (69)..(69): a, c, t, g, unknown or other
  modified_base (75)..(75): a, c, t, g, unknown or other
  modified_base (81)..(81): a, c, t, g, unknown or other
  modified_base (84)..(84): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (126)..(126): a, c, t, g, unknown or other
  modified_base (129)..(129): a, c, t, g, unknown or other
  modified_base (132)..(132): a, c, t, g, unknown or other
  modified_base (135)..(135): a, c, t, g, unknown or other
  modified_base (147)..(147): a, c, t, g, unknown or other
  modified_base (153)..(153): a, c, t, g, unknown or other
  modified_base (156)..(156): a, c, t, g, unknown or other
  modified_base (159)..(159): a, c, t, g, unknown or other
  modified_base (162)..(162): a, c, t, g, unknown or other
  modified_base (168)..(168): a, c, t, g, unknown or other
  modified_base (177)..(177): a, c, t, g, unknown or other
  modified_base (180)..(180): a, c, t, g, unknown or other
  modified_base (183)..(183): a, c, t, g, unknown or other
  modified_base (186)..(186): a, c, t, g, unknown or other
  modified_base (189)..(189): a, c, t, g, unknown or other
  modified_base (192)..(192): a, c, t, g, unknown or other
  modified_base (195)..(195): a, c, t, g, unknown or other
  modified_base (198)..(198): a, c, t, g, unknown or other
  modified_base (201)..(201): a, c, t, g, unknown or other
  modified_base (210)..(210): a, c, t, g, unknown or other
  modified_base (219)..(219): a, c, t, g, unknown or other
  modified_base (222)..(222): a, c, t, g, unknown or other
  modified_base (225)..(225): a, c, t, g, unknown or other
  modified_base (231)..(231): a, c, t, g, unknown or other
  modified_base (237)..(237): a, c, t, g, unknown or other
  modified_base (240)..(240): a, c, t, g, unknown or other
  modified_base (246)..(246): a, c, t, g, unknown or other
  modified_base (252)..(252): a, c, t, g, unknown or other
  modified_base (255)..(255): a, c, t, g, unknown or other
  modified_base (258)..(258): a, c, t, g, unknown or other
  modified_base (270)..(270): a, c, t, g, unknown or other
  modified_base (282)..(282): a, c, t, g, unknown or other
  modified_base (288)..(288): a, c, t, g, unknown or other
  modified_base (291)..(291): a, c, t, g, unknown or other
  modified_base (297)..(297): a, c, t, g, unknown or other
  modified_base (300)..(300): a, c, t, g, unknown or other
  modified_base (303)..(303): a, c, t, g, unknown or other
  modified_base (306)..(306): a, c, t, g, unknown or other
  modified_base (309)..(309): a, c, t, g, unknown or other
  modified_base (315)..(315): a, c, t, g, unknown or other
  modified_base (318)..(318): a, c, t, g, unknown or other
  modified_base (321)..(321): a, c, t, g, unknown or other
  modified_base (324)..(324): a, c, t, g, unknown or other
  modified_base (327)..(327): a, c, t, g, unknown or other
  modified_base (330)..(330): a, c, t, g, unknown or other
  modified_base (342)..(342): a, c, t, g, unknown or other
  modified_base (351)..(351): a, c, t, g, unknown or other
  modified_base (354)..(354): a, c, t, g, unknown or other
  modified_base (357)..(357): a, c, t, g, unknown or other
  modified_base (360)..(360): a, c, t, g, unknown or other
  modified_base (366)..(366): a, c, t, g, unknown or other
  modified_base (369)..(369): a, c, t, g, unknown or other
  modified_base (381)..(381): a, c, t, g, unknown or other
  modified_base (393)..(393): a, c, t, g, unknown or other
  modified_base (396)..(396): a, c, t, g, unknown or other
  modified_base (399)..(399): a, c, t, g, unknown or other
  modified_base (405)..(405): a, c, t, g, unknown or other
  modified_base (411)..(411): a, c, t, g, unknown or other
  modified_base (414)..(414): a, c, t, g, unknown or other
  modified_base (423)..(423): a, c, t, g, unknown or other
  modified_base (429)..(429): a, c, t, g, unknown or other
  modified_base (432)..(432): a, c, t, g, unknown or other
  modified_base (435)..(435): a, c, t, g, unknown or other
  modified_base (438)..(438): a, c, t, g, unknown or other
  modified_base (441)..(441): a, c, t, g, unknown or other
  modified_base (444)..(444): a, c, t, g, unknown or other
  modified_base (447)..(447): a, c, t, g, unknown or other
  modified_base (450)..(450): a, c, t, g, unknown or other
  modified_base (453)..(453): a, c, t, g, unknown or other
  modified_base (462)..(462): a, c, t, g, unknown or other
  modified_base (471)..(471): a, c, t, g, unknown or other
  modified_base (474)..(474): a, c, t, g, unknown or other
  modified_base (477)..(477): a, c, t, g, unknown or other
  modified_base (483)..(483): a, c, t, g, unknown or other
  modified_base (489)..(489): a, c, t, g, unknown or other
  modified_base (492)..(492): a, c, t, g, unknown or other
  modified_base (498)..(498): a, c, t, g, unknown or other
  modified_base (504)..(504): a, c, t, g, unknown or other
  modified_base (507)..(507): a, c, t, g, unknown or other
  modified_base (510)..(510): a, c, t, g, unknown or other
  modified_base (522)..(522): a, c, t, g, unknown or other
  modified_base (534)..(534): a, c, t, g, unknown or other
  modified_base (540)..(540): a, c, t, g, unknown or other
  modified_base (543)..(543): a, c, t, g, unknown or other
  modified_base (549)..(549): a, c, t, g, unknown or other
  modified_base (552)..(552): a, c, t, g, unknown or other
  modified_base (555)..(555): a, c, t, g, unknown or other
  modified_base (558)..(558): a, c, t, g, unknown or other
  modified_base (561)..(561): a, c, t, g, unknown or other
  modified_base (567)..(567): a, c, t, g, unknown or other
  modified_base (570)..(570): a, c, t, g, unknown or other
  modified_base (573)..(573): a, c, t, g, unknown or other
  modified_base (576)..(576): a, c, t, g, unknown or other
  modified_base (579)..(579): a, c, t, g, unknown or other
  modified_base (582)..(582): a, c, t, g, unknown or other
  modified_base (594)..(594): a, c, t, g, unknown or other
  modified_base (603)..(603): a, c, t, g, unknown or other
  modified_base (609)..(609): a, c, t, g, unknown or other
  modified_base (615)..(615): a, c, t, g, unknown or other
  modified_base (618)..(618): a, c, t, g, unknown or other
  modified_base (621)..(621): a, c, t, g, unknown or other
  modified_base (624)..(624): a, c, t, g, unknown or other
  modified_base (627)..(627): a, c, t, g, unknown or other
  modified_base (630)..(630): a, c, t, g, unknown or other
  modified_base (633)..(633): a, c, t, g, unknown or other
  modified_base (636)..(636): a, c, t, g, unknown or other
  modified_base (639)..(639): a, c, t, g, unknown or other
  modified_base (645)..(645): a, c, t, g, unknown or other
  modified_base (648)..(648): a, c, t, g, unknown or other
  modified_base (654)..(654): a, c, t, g, unknown or other
  modified_base (660)..(660): a, c, t, g, unknown or other
  modified_base (669)..(669): a, c, t, g, unknown or other
  modified_base (678)..(678): a, c, t, g, unknown or other
  modified_base (681)..(681): a, c, t, g, unknown or other
  modified_base (684)..(684): a, c, t, g, unknown or other
  modified_base (687)..(687): a, c, t, g, unknown or other
  modified_base (690)..(690): a, c, t, g, unknown or other
  modified_base (693)..(693): a, c, t, g, unknown or other
  modified_base (696)..(696): a, c, t, g, unknown or other
  modified_base (699)..(699): a, c, t, g, unknown or other
  modified_base (702)..(702): a, c, t, g, unknown or other
  modified_base (705)..(705): a, c, t, g, unknown or other
  modified_base (711)..(711): a, c, t, g, unknown or other
  modified_base (717)..(717): a, c, t, g, unknown or other
  modified_base (723)..(723): a, c, t, g, unknown or other
  modified_base (726)..(726): a, c, t, g, unknown or other
  modified_base (732)..(732): a, c, t, g, unknown or other
  modified_base (735)..(735): a, c, t, g, unknown or other
  modified_base (738)..(738): a, c, t, g, unknown or other
  modified_base (750)..(750): a, c, t, g, unknown or other
  modified_base (753)..(753): a, c, t, g, unknown or other
  modified_base (756)..(756): a, c, t, g, unknown or other
  modified_base (759)..(759): a, c, t, g, unknown or other
  modified_base (762)..(762): a, c, t, g, unknown or other
  modified_base (765)..(765): a, c, t, g, unknown or other
  modified_base (771)..(771): a, c, t, g, unknown or other
  modified_base (774)..(774): a, c, t, g, unknown or other
  modified_base (777)..(777): a, c, t, g, unknown or other
  modified_base (780)..(780): a, c, t, g, unknown or other
  modified_base (783)..(783): a, c, t, g, unknown or other
  modified_base (789)..(789): a, c, t, g, unknown or other
  modified_base (792)..(792): a, c, t, g, unknown or other
  modified_base (795)..(795): a, c, t, g, unknown or other
  modified_base (798)..(798): a, c, t, g, unknown or other
  modified_base (801)..(801): a, c, t, g, unknown or other
  modified_base (810)..(810): a, c, t, g, unknown or other
  modified_base (813)..(813): a, c, t, g, unknown or other
  modified_base (816)..(816): a, c, t, g, unknown or other
  modified_base (819)..(819): a, c, t, g, unknown or other
  modified_base (825)..(825): a, c, t, g, unknown or other
  modified_base (828)..(828): a, c, t, g, unknown or other
  modified_base (834)..(834): a, c, t, g, unknown or other
  modified_base (837)..(837): a, c, t, g, unknown or other
  modified_base (840)..(840): a, c, t, g, unknown or other
  modified_base (846)..(846): a, c, t, g, unknown or other
  modified_base (855)..(855): a, c, t, g, unknown or other
  modified_base (858)..(858): a, c, t, g, unknown or other
  modified_base (861)..(861): a, c, t, g, unknown or other
  modified_base (864)..(864): a, c, t, g, unknown or other
  modified_base (873)..(873): a, c, t, g, unknown or other
  modified_base (876)..(876): a, c, t, g, unknown or other
  modified_base (882)..(882): a, c, t, g, unknown or other
  modified_base (885)..(885): a, c, t, g, unknown or other
  modified_base (894)..(894): a, c, t, g, unknown or other
  modified_base (900)..(900): a, c, t, g, unknown or other
  modified_base (903)..(903): a, c, t, g, unknown or other
  modified_base (906)..(906): a, c, t, g, unknown or other
  modified_base (909)..(909): a, c, t, g, unknown or other
  modified_base (912)..(912): a, c, t, g, unknown or other
  modified_base (924)..(924): a, c, t, g, unknown or other
  modified_base (927)..(927): a, c, t, g, unknown or other
  modified_base (933)..(933): a, c, t, g, unknown or other
  modified_base (936)..(936): a, c, t, g, unknown or other
  modified_base (939)..(939): a, c, t, g, unknown or other
  modified_base (945)..(945): a, c, t, g, unknown or other
  modified_base (951)..(951): a, c, t, g, unknown or other
  modified_base (957)..(957): a, c, t, g, unknown or other
  modified_base (966)..(966): a, c, t, g, unknown or other
  modified_base (969)..(969): a, c, t, g, unknown or other
  modified_base (975)..(975): a, c, t, g, unknown or other
  modified_base (981)..(981): a, c, t, g, unknown or other
  modified_base (984)..(984): a, c, t, g, unknown or other
  modified_base (993)..(993): a, c, t, g, unknown or other
  modified_base (996)..(996): a, c, t, g, unknown or other
  modified_base (1002)..(1002): a, c, t, g, unknown or other
  modified_base (1008)..(1008): a, c, t, g, unknown or other
  modified_base (1011)..(1011): a, c, t, g, unknown or other
  modified_base (1017)..(1017): a, c, t, g, unknown or other
  modified_base (1023)..(1023): a, c, t, g, unknown or other
  modified_base (1029)..(1029): a, c, t, g, unknown or other
  modified_base (1032)..(1032): a, c, t, g, unknown or other
  modified_base (1035)..(1035): a, c, t, g, unknown or other
  modified_base (1038)..(1038): a, c, t, g, unknown or other
  modified_base (1041)..(1041): a, c, t, g, unknown or other
  modified_base (1044)..(1044): a, c, t, g, unknown or other
  modified_base (1047)..(1047): a, c, t, g, unknown or other
  modified_base (1056)..(1056): a, c, t, g, unknown or other
  modified_base (1062)..(1062): a, c, t, g, unknown or other
  modified_base (1071)..(1071): a, c, t, g, unknown or other
  modified_base (1074)..(1074): a, c, t, g, unknown or other
  modified_base (1086)..(1086): a, c, t, g, unknown or other
  modified_base (1089)..(1089): a, c, t, g, unknown or other
  modified_base (1095)..(1095): a, c, t, g, unknown or other
  modified_base (1098)..(1098): a, c, t, g, unknown or other
  modified_base (1101)..(1101): a, c, t, g, unknown or other
  modified_base (1104)..(1104): a, c, t, g, unknown or other
  modified_base (1110)..(1110): a, c, t, g, unknown or other
  modified_base (1116)..(1116): a, c, t, g, unknown or other
  modified_base (1131)..(1131): a, c, t, g, unknown or other
  modified_base (1137)..(1137): a, c, t, g, unknown or other
  modified_base (1140)..(1140): a, c, t, g, unknown or other
  modified_base (1143)..(1143): a, c, t, g, unknown or other
  modified_base (1146)..(1146): a, c, t, g, unknown or other
  modified_base (1152)..(1152): a, c, t, g, unknown or other
  modified_base (1158)..(1158): a, c, t, g, unknown or other
  modified_base (1161)..(1161): a, c, t, g, unknown or other
  modified_base (1164)..(1164): a, c, t, g, unknown or other
  modified_base (1167)..(1167): a, c, t, g, unknown or other
  modified_base (1170)..(1170): a, c, t, g, unknown or other
  modified_base (1173)..(1173): a, c, t, g, unknown or other
  modified_base (1179)..(1179): a, c, t, g, unknown or other
  modified_base (1182)..(1182): a, c, t, g, unknown or other
  modified_base (1185)..(1185): a, c, t, g, unknown or other
  modified_base (1188)..(1188): a, c, t, g, unknown or other
  modified_base (1191)..(1191): a, c, t, g, unknown or other
  modified_base (1194)..(1194): a, c, t, g, unknown or other
  modified_base (1197)..(1197): a, c, t, g, unknown or other
  modified_base (1200)..(1200): a, c, t, g, unknown or other
  modified_base (1209)..(1209): a, c, t, g, unknown or other
  modified_base (1212)..(1212): a, c, t, g, unknown or other
  modified_base (1215)..(1215): a, c, t, g, unknown or other
  modified_base (1218)..(1218): a, c, t, g, unknown or other
  modified_base (1221)..(1221): a, c, t, g, unknown or other
  modified_base (1224)..(1224): a, c, t, g, unknown or other
  modified_base (1227)..(1227): a, c, t, g, unknown or other
  modified_base (1230)..(1230): a, c, t, g, unknown or other
  modified_base (1233)..(1233): a, c, t, g, unknown or other
  modified_base (1239)..(1239): a, c, t, g, unknown or other
  modified_base (1242)..(1242): a, c, t, g, unknown or other
  modified_base (1245)..(1245): a, c, t, g, unknown or other
  modified_base (1251)..(1251): a, c, t, g, unknown or other
  modified_base (1257)..(1257): a, c, t, g, unknown or other
  modified_base (1260)..(1260): a, c, t, g, unknown or other
  modified_base (1266)..(1266): a, c, t, g, unknown or other
  modified_base (1272)..(1272): a, c, t, g, unknown or other
  modified_base (1275)..(1275): a, c, t, g, unknown or other
  modified_base (1278)..(1278): a, c, t, g, unknown or other
  modified_base (1281)..(1281): a, c, t, g, unknown or other
  modified_base (1284)..(1284): a, c, t, g, unknown or other
  modified_base (1287)..(1287): a, c, t, g, unknown or other
  modified_base (1293)..(1293): a, c, t, g, unknown or other
  modified_base (1299)..(1299): a, c, t, g, unknown or other
  modified_base (1302)..(1302): a, c, t, g, unknown or other
  modified_base (1305)..(1305): a, c, t, g, unknown or other
  modified_base (1317)..(1317): a, c, t, g, unknown or other
  modified_base (1320)..(1320): a, c, t, g, unknown or other
  modified_base (1323)..(1323): a, c, t, g, unknown or other
  modified_base (1326)..(1326): a, c, t, g, unknown or other
  modified_base (1329)..(1329): a, c, t, g, unknown or other
  modified_base (1332)..(1332): a, c, t, g, unknown or other
  modified_base (1338)..(1338): a, c, t, g, unknown or other
  modified_base (1341)..(1341): a, c, t, g, unknown or other
  modified_base (1347)..(1347): a, c, t, g, unknown or other
  modified_base (1350)..(1350): a, c, t, g, unknown or other
  modified_base (1353)..(1353): a, c, t, g, unknown or other
  modified_base (1359)..(1359): a, c, t, g, unknown or other
  modified_base (1362)..(1362): a, c, t, g, unknown or other
  modified_base (1365)..(1365): a, c, t, g, unknown or other
  modified_base (1368)..(1368): a, c, t, g, unknown or other
  modified_base (1374)..(1374): a, c, t, g, unknown or other
  modified_base (1377)..(1377): a, c, t, g, unknown or other
  modified_base (1380)..(1380): a, c, t, g, unknown or other
  modified_base (1386)..(1386): a, c, t, g, unknown or other
  modified_base (1389)..(1389): a, c, t, g, unknown or other
  modified_base (1395)..(1395): a, c, t, g, unknown or other
  modified_base (1398)..(1398): a, c, t, g, unknown or other
  modified_base (1404)..(1404): a, c, t, g, unknown or other
  modified_base (1407)..(1407): a, c, t, g, unknown or other
  modified_base (1410)..(1410): a, c, t, g, unknown or other
  modified_base (1416)..(1416): a, c, t, g, unknown or other
  modified_base (1422)..(1422): a, c, t, g, unknown or other
  modified_base (1425)..(1425): a, c, t, g, unknown or other
  modified_base (1428)..(1428): a, c, t, g, unknown or other
  modified_base (1434)..(1434): a, c, t, g, unknown or other
gcngcngcngtngtnwsncayttyaaygaytgyccngaywsncayacncarttytgyttycayggnacntgymgnttyytngtncargargayaarccngcntgygtntgycaywsnggntaygtnggngcnmgntgygarcaygcngayytnytngcngcnatggcngargarggnggnwsnytngcngcnytnacngcncaycargcntgycayytnccnytngaracnttyacnmgncaymgncarccnmgnggntgggarcarytngarcartgyggntayccngtncarmgnytngtngcnytntayytngcngcnmgnytnwsntggaaycargtngaycargtnytngcnggnaayccngcnaarcaygayytngayathaarccnacngtnathwsncaymgnytncayttyccngarggnggnwsnytngcngcnytnacngcncaycargcntgycayytnccnytngaracnttyacnmgncaymgncarccnmgnggntgggarcarytngarcartgyggntayccngtncarmgnytngtngcnytntayytngcngcnmgnytnwsntggaaycargtngaycargtnathmgnaaygcnytngcnwsnccnggnwsnggnggngayytnggngargcnathmgngarcarccngarcargcnmgnytngcnytnacnytngcngcngcngarwsngarmgnttygtnmgncarggnacnggnaaygaygargcnggngcngcnwsngcngaygtngtnwsnytnacntgyccngtngcngcnggngartgygcnggnccngcngaywsnggngaygcnytnytngarmgnaaytayccnacnggngcngarttyytnggngayggnggngayathwsnttywsnacnmgnggnacncaraaytggacngtngarmgnytnytncargcncaymgncarytngargarmgnggntaygtnttygtnggntaycayggnacnttyytngargcngcncarwsnathgtnttyggnggngtnmgngcnmgnwsncargayytngaygcnathtggmgnggnttytayathgcnggngayccngcnytngcntayggntaygcncargaycargarccngaygcnmgnggnmgnathmgnaayggngcnytnytnmgngtntaygtnccnmgnwsnwsnytnccnggnttytaymgnacnggnytnacnytngcngcnccngargcngcnggngargtngarmgnytnathggncayccnytnccnytnmgnytngaygcnathacnggnccngargargarggnggngcnytngcnacnathytnggntggccnytngcngarmgnacngtngtnathccnwsngcnathccnacngayccnmgnaaygtnggnggngayytngayccnwsnwsnathccn

SEQ ID NO: 52 - DNA, 1257 bp, Artificial Sequence
  source: /note="Description of Artificial Sequence: Synthetic polynucleotide"
  source: /note="PE ribotoxic region polynucleotide variant 3"
  modified_base (3)..(3): a, c, t, g, unknown or other
  modified_base (6)..(6): a, c, t, g, unknown or other
  modified_base (9)..(9): a, c, t, g, unknown or other
  modified_base (12)..(12): a, c, t, g, unknown or other
  modified_base (15)..(15): a, c, t, g, unknown or other
  modified_base (18)..(18): a, c, t, g, unknown or other
  modified_base (36)..(36): a, c, t, g, unknown or other
  modified_base (42)..(42): a, c, t, g, unknown or other
  modified_base (48)..(48): a, c, t, g, unknown or other
  modified_base (66)..(66): a, c, t, g, unknown or other
  modified_base (69)..(69): a, c, t, g, unknown or other
  modified_base (75)..(75): a, c, t, g, unknown or other
  modified_base (81)..(81): a, c, t, g, unknown or other
  modified_base (84)..(84): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (126)..(126): a, c, t, g, unknown or other
  modified_base (129)..(129): a, c, t, g, unknown or other
  modified_base (132)..(132): a, c, t, g, unknown or other
  modified_base (135)..(135): a, c, t, g, unknown or other
  modified_base (147)..(147): a, c, t, g, unknown or other
  modified_base (153)..(153): a, c, t, g, unknown or other
  modified_base (156)..(156): a, c, t, g, unknown or other
  modified_base (159)..(159): a, c, t, g, unknown or other
  modified_base (162)..(162): a, c, t, g, unknown or other
  modified_base (168)..(168): a, c, t, g, unknown or other
  modified_base (177)..(177): a, c, t, g, unknown or other
  modified_base (180)..(180): a, c, t, g, unknown or other
  modified_base (183)..(183): a, c, t, g, unknown or other
  modified_base (186)..(186): a, c, t, g, unknown or other
  modified_base (189)..(189): a, c, t, g, unknown or other
  modified_base (192)..(192): a, c, t, g, unknown or other
  modified_base (195)..(195): a, c, t, g, unknown or other
  modified_base (198)..(198): a, c, t, g, unknown or other
  modified_base (201)..(201): a, c, t, g, unknown or other
  modified_base (210)..(210): a, c, t, g, unknown or other
  modified_base (219)..(219): a, c, t, g, unknown or other
  modified_base (222)..(222): a, c, t, g, unknown or other
  modified_base (225)..(225): a, c, t, g, unknown or other
  modified_base (231)..(231): a, c, t, g, unknown or other
  modified_base (237)..(237): a, c, t, g, unknown or other
  modified_base (240)..(240): a, c, t, g, unknown or other
  modified_base (246)..(246): a, c, t, g, unknown or other
  modified_base (252)..(252): a, c, t, g, unknown or other
  modified_base (255)..(255): a, c, t, g, unknown or other
  modified_base (258)..(258): a, c, t, g, unknown or other
  modified_base (270)..(270): a, c, t, g, unknown or other
  modified_base (282)..(282): a, c, t, g, unknown or other
  modified_base (288)..(288): a, c, t, g, unknown or other
  modified_base (291)..(291): a, c, t, g, unknown or other
  modified_base (297)..(297): a, c, t, g, unknown or other
  modified_base (300)..(300): a, c, t, g, unknown or other
  modified_base (303)..(303): a, c, t, g, unknown or other
  modified_base (306)..(306): a, c, t, g, unknown or other
  modified_base (309)..(309): a, c, t, g, unknown or other
  modified_base (315)..(315): a, c, t, g, unknown or other
  modified_base (318)..(318): a, c, t, g, unknown or other
  modified_base (321)..(321): a, c, t, g, unknown or other
  modified_base (324)..(324): a, c, t, g, unknown or other
  modified_base (327)..(327): a, c, t, g, unknown or other
  modified_base (330)..(330): a, c, t, g, unknown or other
  modified_base (342)..(342): a, c, t, g, unknown or other
  modified_base (351)..(351): a, c, t, g, unknown or other
  modified_base (357)..(357): a, c, t, g, unknown or other
  modified_base (363)..(363): a, c, t, g, unknown or other
  modified_base (366)..(366): a, c, t, g, unknown or other
  modified_base (369)..(369): a, c, t, g, unknown or other
  modified_base (372)..(372): a, c, t, g, unknown or other
  modified_base (375)..(375): a, c, t, g, unknown or other
  modified_base (378)..(378): a, c, t, g, unknown or other
  modified_base (381)..(381): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (396)..(396): a, c, t, g, unknown or other
  modified_base (402)..(402): a, c, t, g, unknown or other
  modified_base (408)..(408): a, c, t, g, unknown or other
  modified_base (417)..(417): a, c, t, g, unknown or other
  modified_base (426)..(426): a, c, t, g, unknown or other
  modified_base (429)..(429): a, c, t, g, unknown or other
  modified_base (432)..(432): a, c, t, g, unknown or other
  modified_base (435)..(435): a, c, t, g, unknown or other
  modified_base (438)..(438): a, c, t, g, unknown or other
  modified_base (441)..(441): a, c, t, g, unknown or other
  modified_base (444)..(444): a, c, t, g, unknown or other
  modified_base (447)..(447): a, c, t, g, unknown or other
  modified_base (450)..(450): a, c, t, g, unknown or other
  modified_base (453)..(453): a, c, t, g, unknown or other
  modified_base (459)..(459): a, c, t, g, unknown or other
  modified_base (465)..(465): a, c, t, g, unknown or other
  modified_base (471)..(471): a, c, t, g, unknown or other
  modified_base (474)..(474): a, c, t, g, unknown or other
  modified_base (480)..(480): a, c, t, g, unknown or other
  modified_base (483)..(483): a, c, t, g, unknown or other
  modified_base (486)..(486): a, c, t, g, unknown or other
  modified_base (498)..(498): a, c, t, g, unknown or other
  modified_base (501)..(501): a, c, t, g, unknown or other
  modified_base (504)..(504): a, c, t, g, unknown or other
  modified_base (507)..(507): a, c, t, g, unknown or other
  modified_base (513)..(513): a, c, t, g, unknown or other
  modified_base (519)..(519): a, c, t, g, unknown or other
  modified_base (522)..(522): a, c, t, g, unknown or other
  modified_base (525)..(525): a, c, t, g, unknown or other
  modified_base (528)..(528): a, c, t, g, unknown or other
  modified_base (531)..(531): a, c, t, g, unknown or other
  modified_base (537)..(537): a, c, t, g, unknown or other
  modified_base (540)..(540): a, c, t, g, unknown or other
  modified_base (543)..(543): a, c, t, g, unknown or other
  modified_base (546)..(546): a, c, t, g, unknown or other
  modified_base (549)..(549): a, c, t, g, unknown or other
  modified_base (558)..(558): a, c, t, g, unknown or other
  modified_base (561)..(561): a, c, t, g, unknown or other
  modified_base (564)..(564): a, c, t, g, unknown or other
  modified_base (567)..(567): a, c, t, g, unknown or other
  modified_base (573)..(573): a, c, t, g, unknown or other
  modified_base (576)..(576): a, c, t, g, unknown or other
  modified_base (582)..(582): a, c, t, g, unknown or other
  modified_base (585)..(585): a, c, t, g, unknown or other
  modified_base (588)..(588): a, c, t, g, unknown or other
  modified_base (594)..(594): a, c, t, g, unknown or other
  modified_base (603)..(603): a, c, t, g, unknown or other
  modified_base (606)..(606): a, c, t, g, unknown or other
  modified_base (609)..(609): a, c, t, g, unknown or other
  modified_base (612)..(612): a, c, t, g, unknown or other
  modified_base (621)..(621): a, c, t, g, unknown or other
  modified_base (624)..(624): a, c, t, g, unknown or other
  modified_base (630)..(630): a, c, t, g, unknown or other
  modified_base (633)..(633): a, c, t, g, unknown or other
  modified_base (639)..(639): a, c, t, g, unknown or other
  modified_base (642)..(642): a, c, t, g, unknown or other
  modified_base (648)..(648): a, c, t, g, unknown or other
  modified_base (651)..(651): a, c, t, g, unknown or other
  modified_base (654)..(654): a, c, t, g, unknown or other
  modified_base (657)..(657): a, c, t, g, unknown or other
  modified_base (660)..(660): a, c, t, g, unknown or other
  modified_base (672)..(672): a, c, t, g, unknown or other
  modified_base (675)..(675): a, c, t, g, unknown or other
  modified_base (681)..(681): a, c, t, g, unknown or other
  modified_base (684)..(684): a, c, t, g, unknown or other
  modified_base (687)..(687): a, c, t, g, unknown or other
  modified_base (693)..(693): a, c, t, g, unknown or other
  modified_base (699)..(699): a, c, t, g, unknown or other
  modified_base (705)..(705): a, c, t, g, unknown or other
  modified_base (714)..(714): a, c, t, g, unknown or other
  modified_base (717)..(717): a, c, t, g, unknown or other
  modified_base (723)..(723): a, c, t, g, unknown or other
  modified_base (729)..(729): a, c, t, g, unknown or other
  modified_base (732)..(732): a, c, t, g, unknown or other
  modified_base (741)..(741): a, c, t, g, unknown or other
  modified_base (744)..(744): a, c, t, g, unknown or other
  modified_base (750)..(750): a, c, t, g, unknown or other
  modified_base (756)..(756): a, c, t, g, unknown or other
  modified_base (759)..(759): a, c, t, g, unknown or other
  modified_base (765)..(765): a, c, t, g, unknown or other
  modified_base (771)..(771): a, c, t, g, unknown or other
  modified_base (777)..(777): a, c, t, g, unknown or other
  modified_base (780)..(780): a, c, t, g, unknown or other
  modified_base (783)..(783): a, c, t, g, unknown or other
  modified_base (786)..(786): a, c, t, g, unknown or other
  modified_base (789)..(789): a, c, t, g, unknown or other
  modified_base (792)..(792): a, c, t, g, unknown or other
  modified_base (795)..(795): a, c, t, g, unknown or other
  modified_base (804)..(804): a, c, t, g, unknown or other
  modified_base (810)..(810): a, c, t, g, unknown or other
  modified_base (819)..(819): a, c, t, g, unknown or other
  modified_base (822)..(822): a, c, t, g, unknown or other
  modified_base (834)..(834): a, c, t, g, unknown or other
  modified_base (837)..(837): a, c, t, g, unknown or other
  modified_base (843)..(843): a, c, t, g, unknown or other
  modified_base (846)..(846): a, c, t, g, unknown or other
  modified_base (849)..(849): a, c, t, g, unknown or other
  modified_base (852)..(852): a, c, t, g, unknown or other
  modified_base (858)..(858): a, c, t, g, unknown or other
  modified_base (864)..(864): a, c, t, g, unknown or other
  modified_base (879)..(879): a, c, t, g, unknown or other
  modified_base (885)..(885): a, c, t, g, unknown or other
  modified_base (888)..(888): a, c, t, g, unknown or other
  modified_base (891)..(891): a, c, t, g, unknown or other
  modified_base (894)..(894): a, c, t, g, unknown or other
  modified_base (900)..(900): a, c, t, g, unknown or other
  modified_base (906)..(906): a, c, t, g, unknown or other
  modified_base (909)..(909): a, c, t, g, unknown or other
  modified_base (912)..(912): a, c, t, g, unknown or other
  modified_base (915)..(915): a, c, t, g, unknown or other
  modified_base (918)..(918): a, c, t, g, unknown or other
  modified_base (921)..(921): a, c, t, g, unknown or other
  modified_base (927)..(927): a, c, t, g, unknown or other
  modified_base (930)..(930): a, c, t, g, unknown or other
  modified_base (933)..(933): a, c, t, g, unknown or other
  modified_base (936)..(936): a, c, t, g, unknown or other
  modified_base (939)..(939): a, c, t, g, unknown or other
  modified_base (942)..(942): a, c, t, g, unknown or other
  modified_base (945)..(945): a, c, t, g, unknown or other
  modified_base (948)..(948): a, c, t, g, unknown or other
  modified_base (957)..(957): a, c, t, g, unknown or other
  modified_base (960)..(960): a, c, t, g, unknown or other
  modified_base (963)..(963): a, c, t, g, unknown or other
  modified_base (966)..(966): a, c, t, g, unknown or other
  modified_base (969)..(969): a, c, t, g, unknown or other
  modified_base (972)..(972): a, c, t, g, unknown or other
  modified_base (975)..(975): a, c, t, g, unknown or other
  modified_base (978)..(978): a, c, t, g, unknown or other
  modified_base (981)..(981): a, c, t, g, unknown or other
  modified_base (987)..(987): a, c, t, g, unknown or other
  modified_base (990)..(990): a, c, t, g, unknown or other
  modified_base (993)..(993): a, c, t, g, unknown or other
  modified_base (999)..(999): a, c, t, g, unknown or other
  modified_base (1005)..(1005): a, c, t, g, unknown or other
  modified_base (1008)..(1008): a, c, t, g, unknown or other
  modified_base (1014)..(1014): a, c, t, g, unknown or other
  modified_base (1020)..(1020): a, c, t, g, unknown or other
  modified_base (1023)..(1023): a, c, t, g, unknown or other
  modified_base (1026)..(1026): a, c, t, g, unknown or other
  modified_base (1029)..(1029): a, c, t, g, unknown or other
  modified_base (1032)..(1032): a, c, t, g, unknown or other
  modified_base (1035)..(1035): a, c, t, g, unknown or other
  modified_base (1041)..(1041): a, c, t, g, unknown or other
  modified_base (1047)..(1047): a, c, t, g, unknown or other
  modified_base (1050)..(1050): a, c, t, g, unknown or other
  modified_base (1053)..(1053): a, c, t, g, unknown or other
  modified_base (1065)..(1065): a, c, t, g, unknown or other
  modified_base (1068)..(1068): a, c, t, g, unknown or other
  modified_base (1071)..(1071): a, c, t, g, unknown or other
  modified_base (1074)..(1074): a, c, t, g, unknown or other
  modified_base (1077)..(1077): a, c, t, g, unknown or other
  modified_base (1080)..(1080): a, c, t, g, unknown or other
  modified_base (1086)..(1086): a, c, t, g, unknown or other
  modified_base (1089)..(1089): a, c, t, g, unknown or other
  modified_base (1095)..(1095): a, c, t, g, unknown or other
  modified_base (1098)..(1098): a, c, t, g, unknown or other
  modified_base (1101)..(1101): a, c, t, g, unknown or other
  modified_base (1107)..(1107): a, c, t, g, unknown or other
  modified_base (1110)..(1110): a, c, t, g, unknown or other
  modified_base (1113)..(1113): a, c, t, g, unknown or other
  modified_base (1116)..(1116): a, c, t, g, unknown or other
  modified_base (1122)..(1122): a, c, t, g, unknown or other
  modified_base (1125)..(1125): a, c, t, g, unknown or other
  modified_base (1128)..(1128): a, c, t, g, unknown or other
  modified_base (1134)..(1134): a, c, t, g, unknown or other
  modified_base (1137)..(1137): a, c, t, g, unknown or other
  modified_base (1143)..(1143): a, c, t, g, unknown or other
  modified_base (1146)..(1146): a, c, t, g, unknown or other
  modified_base (1152)..(1152): a, c, t, g, unknown or other
  modified_base (1155)..(1155): a, c, t, g, unknown or other
  modified_base (1158)..(1158): a, c, t, g, unknown or other
  modified_base (1164)..(1164): a, c, t, g, unknown or other
  modified_base (1170)..(1170): a, c, t, g, unknown or other
  modified_base (1173)..(1173): a, c, t, g, unknown or other
  modified_base (1176)..(1176): a, c, t, g, unknown or other
  modified_base (1182)..(1182): a, c, t, g, unknown or other
  modified_base (1197)..(1197): a, c, t, g, unknown or other
  modified_base (1203)..(1203): a, c, t, g, unknown or other
  modified_base (1206)..(1206): a, c, t, g, unknown or other
  modified_base (1209)..(1209): a, c, t, g, unknown or other
  modified_base (1212)..(1212): a, c, t, g, unknown or other
  modified_base (1221)..(1221): a, c, t, g, unknown or other
  modified_base (1224)..(1224): a, c, t, g, unknown or other
  modified_base (1230)..(1230): a, c, t, g, unknown or other
  modified_base (1233)..(1233): a, c, t, g, unknown or other
  modified_base (1239)..(1239): a, c, t, g, unknown or other
  modified_base (1242)..(1242): a, c, t, g, unknown or other
  modified_base (1245)..(1245): a, c, t, g, unknown or other
  modified_base (1254)..(1254): a, c, t, g, unknown or other
gcngcngcngtngtnwsncayttyaaygaytgyccngaywsncayacncarttytgyttycayggnacntgymgnttyytngtncargargayaarccngcntgygtntgycaywsnggntaygtnggngcnmgntgygarcaygcngayytnytngcngcnatggcngargarggnggnwsnytngcngcnytnacngcncaycargcntgycayytnccnytngaracnttyacnmgncaymgncarccnmgnggntgggarcarytngarcartgyggntayccngtncarmgnytngtngcnytntayytngcngcnmgnytnwsntggaaycargtngaycargtnathmgnaaygcnytngcnwsnccnggnwsnggnggngayytnggngargcnathmgngarcarccngarcargcnmgnytngcnytnacnytngcngcngcngarwsngarmgnttygtnmgncarggnacnggnaaygaygargcnggngcngcnaaygcngaygtngtnwsnytnacntgyccngtngcngcnggngartgygcnggnccngcngaywsnggngaygcnytnytngarmgnaaytayccnacnggngcngarttyytnggngayggnggngaygtnwsnttywsnacnmgnggnacncaraaytggacngtngarmgnytnytncargcncaymgncarytngargarmgnggntaygtnttygtnggntaycayggnacnttyytngargcngcncarwsnathgtnttyggnggngtnmgngcnmgnwsncargayytngaygcnathtggmgnggnttytayathgcnggngayccngcnytngcntayggntaygcncargaycargarccngaygcnmgnggnmgnathmgnaayggngcnytnytnmgngtntaygtnccnmgnwsnwsnytnccnggnttytaymgnacnwsnytnacnytngcngcnccngargcngcnggngargtngarmgnytnathggncayccnytnccnytnmgnytngaygcnathacnggnccngargargarggnggngcnytngcnacnathytnggntggccnytngcngarmgnacngtngtnathccnwsngcnathccnacngayccnmgnaaygtnggnggngayytngayccnwsnwsnathccngayaargarcargcnathwsngcnytnccngaytaygcnwsncarccnggnaarccnccnmgngargayytnaar

SEQ ID NO: 53 - DNA, 1605 bp, Artificial Sequence
  source: /note="Description of Artificial Sequence: Synthetic polynucleotide"
  source: /note="PE ribotoxic region polynucleotide variant 4"
  modified_base (3)..(3): a, c, t, g, unknown or other
  modified_base (6)..(6): a, c, t, g, unknown or other
  modified_base (9)..(9): a, c, t, g, unknown or other
  modified_base (12)..(12): a, c, t, g, unknown or other
  modified_base (15)..(15): a, c, t, g, unknown or other
  modified_base (18)..(18): a, c, t, g, unknown or other
  modified_base (36)..(36): a, c, t, g, unknown or other
  modified_base (42)..(42): a, c, t, g, unknown or other
  modified_base (48)..(48): a, c, t, g, unknown or other
  modified_base (66)..(66): a, c, t, g, unknown or other
  modified_base (69)..(69): a, c, t, g, unknown or other
  modified_base (75)..(75): a, c, t, g, unknown or other
  modified_base (81)..(81): a, c, t, g, unknown or other
  modified_base (84)..(84): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (126)..(126): a, c, t, g, unknown or other
  modified_base (129)..(129): a, c, t, g, unknown or other
  modified_base (132)..(132): a, c, t, g, unknown or other
  modified_base (135)..(135): a, c, t, g, unknown or other
  modified_base (147)..(147): a, c, t, g, unknown or other
  modified_base (153)..(153): a, c, t, g, unknown or other
  modified_base (156)..(156): a, c, t, g, unknown or other
  modified_base (159)..(159): a, c, t, g, unknown or other
  modified_base (162)..(162): a, c, t, g, unknown or other
  modified_base (168)..(168): a, c, t, g, unknown or other
  modified_base (177)..(177): a, c, t, g, unknown or other
  modified_base (180)..(180): a, c, t, g, unknown or other
  modified_base (183)..(183): a, c, t, g, unknown or other
  modified_base (186)..(186): a, c, t, g, unknown or other
  modified_base (189)..(189): a, c, t, g, unknown or other
  modified_base (192)..(192): a, c, t, g, unknown or other
  modified_base (195)..(195): a, c, t, g, unknown or other
  modified_base (198)..(198): a, c, t, g, unknown or other
  modified_base (201)..(201): a, c, t, g, unknown or other
  modified_base (210)..(210): a, c, t, g, unknown or other
  modified_base (219)..(219): a, c, t, g, unknown or other
  modified_base (222)..(222): a, c, t, g, unknown or other
  modified_base (225)..(225): a, c, t, g, unknown or other
  modified_base (231)..(231): a, c, t, g, unknown or other
  modified_base (237)..(237): a, c, t, g, unknown or other
  modified_base (240)..(240): a, c, t, g, unknown or other
  modified_base (246)..(246): a, c, t, g, unknown or other
  modified_base (252)..(252): a, c, t, g, unknown or other
  modified_base (255)..(255): a, c, t, g, unknown or other
  modified_base (258)..(258): a, c, t, g, unknown or other
  modified_base (270)..(270): a, c, t, g, unknown or other
  modified_base (282)..(282): a, c, t, g, unknown or other
  modified_base (288)..(288): a, c, t, g, unknown or other
  modified_base (291)..(291): a, c, t, g, unknown or other
  modified_base (297)..(297): a, c, t, g, unknown or other
  modified_base (300)..(300): a, c, t, g, unknown or other
  modified_base (303)..(303): a, c, t, g, unknown or other
  modified_base (306)..(306): a, c, t, g, unknown or other
  modified_base (309)..(309): a, c, t, g, unknown or other
  modified_base (315)..(315): a, c, t, g, unknown or other
  modified_base (318)..(318): a, c, t, g, unknown or other
  modified_base (321)..(321): a, c, t, g, unknown or other
  modified_base (324)..(324): a, c, t, g, unknown or other
  modified_base (327)..(327): a, c, t, g, unknown or other
  modified_base (330)..(330): a, c, t, g, unknown or other
  modified_base (342)..(342): a, c, t, g, unknown or other
  modified_base (351)..(351): a, c, t, g, unknown or other
  modified_base (354)..(354): a, c, t, g, unknown or other
  modified_base (357)..(357): a, c, t, g, unknown or other
  modified_base (360)..(360): a, c, t, g, unknown or other
  modified_base (363)..(363): a, c, t, g, unknown or other
  modified_base (366)..(366): a, c, t, g, unknown or other
  modified_base (384)..(384): a, c, t, g, unknown or other
  modified_base (390)..(390): a, c, t, g, unknown or other
  modified_base (396)..(396): a, c, t, g, unknown or other
  modified_base (414)..(414): a, c, t, g, unknown or other
  modified_base (417)..(417): a, c, t, g, unknown or other
  modified_base (423)..(423): a, c, t, g, unknown or other
  modified_base (429)..(429): a, c, t, g, unknown or other
  modified_base (432)..(432): a, c, t, g, unknown or other
  modified_base (447)..(447): a, c, t, g, unknown or other
  modified_base (450)..(450): a, c, t, g, unknown or other
  modified_base (456)..(456): a, c, t, g, unknown or other
  modified_base (465)..(465): a, c, t, g, unknown or other
  modified_base (468)..(468): a, c, t, g, unknown or other
  modified_base (474)..(474): a, c, t, g, unknown or other
  modified_base (477)..(477): a, c, t, g, unknown or other
  modified_base (480)..(480): a, c, t, g, unknown or other
  modified_base (483)..(483): a, c, t, g, unknown or other
  modified_base (495)..(495): a, c, t, g, unknown or other
  modified_base (501)..(501): a, c, t, g, unknown or other
  modified_base (504)..(504): a, c, t, g, unknown or other
  modified_base (507)..(507): a, c, t, g, unknown or other
  modified_base (510)..(510): a, c, t, g, unknown or other
  modified_base (516)..(516): a, c, t, g, unknown or other
  modified_base (525)..(525): a, c, t, g, unknown or other
  modified_base (528)..(528): a, c, t, g, unknown or other
  modified_base (531)..(531): a, c, t, g, unknown or other
  modified_base (534)..(534): a, c, t, g, unknown or other
  modified_base (537)..(537): a, c, t, g, unknown or other
  modified_base (540)..(540): a, c, t, g, unknown or other
  modified_base (543)..(543): a, c, t, g, unknown or other
  modified_base (546)..(546): a, c, t, g, unknown or other
  modified_base (549)..(549): a, c, t, g, unknown or other
  modified_base (558)..(558): a, c, t, g, unknown or other
  modified_base (561)..(561): a, c, t, g, unknown or other
  modified_base (567)..(567): a, c, t, g, unknown or other
  modified_base (570)..(570): a, c, t, g, unknown or other
  modified_base (573)..(573): a, c, t, g, unknown or other
  modified_base (579)..(579): a, c, t, g, unknown or other
  modified_base (582)..(582): a, c, t, g, unknown or other
  modified_base (585)..(585): a, c, t, g, unknown or other
  modified_base (588)..(588): a, c, t, g, unknown or other
  modified_base (594)..(594): a, c, t, g, unknown or other
  modified_base (600)..(600): a, c, t, g, unknown or other
  modified_base (603)..(603): a, c, t, g, unknown or other
  modified_base (606)..(606): a, c, t, g, unknown or other
  modified_base (618)..(618): a, c, t, g, unknown or other
  modified_base (627)..(627): a, c, t, g, unknown or other
  modified_base (630)..(630): a, c, t, g, unknown or other
  modified_base (636)..(636): a, c, t, g, unknown or other
  modified_base (639)..(639): a, c, t, g, unknown or other
  modified_base (645)..(645): a, c, t, g, unknown or other
  modified_base (648)..(648): a, c, t, g, unknown or other
  modified_base (651)..(651): a, c, t, g, unknown or other
  modified_base (654)..(654): a, c, t, g, unknown or other
  modified_base (657)..(657): a, c, t, g, unknown or other
  modified_base (663)..(663): a, c, t, g, unknown or other
  modified_base (666)..(666): a, c, t, g, unknown or other
  modified_base (669)..(669): a, c, t, g, unknown or other
  modified_base (672)..(672): a, c, t, g, unknown or other
  modified_base (675)..(675): a, c, t, g, unknown or other
  modified_base (678)..(678): a, c, t, g, unknown or other
  modified_base (690)..(690): a, c, t, g, unknown or other
  modified_base (699)..(699): a, c, t, g, unknown or other
  modified_base (705)..(705): a, c, t, g, unknown or other
  modified_base (711)..(711): a, c, t, g, unknown or other
  modified_base (714)..(714): a, c, t, g, unknown or other
  modified_base (717)..(717): a, c, t, g, unknown or other
  modified_base (720)..(720): a, c, t, g, unknown or other
  modified_base (723)..(723): a, c, t, g, unknown or other
  modified_base (726)..(726): a, c, t, g, unknown or other
  modified_base (729)..(729): a, c, t, g, unknown or other
  modified_base (732)..(732): a, c, t, g, unknown or other
  modified_base (735)..(735): a, c, t, g, unknown or other
  modified_base (741)..(741): a, c, t, g, unknown or other
  modified_base (744)..(744): a, c, t, g, unknown or other
  modified_base (750)..(750): a, c, t, g, unknown or other
  modified_base (756)..(756): a, c, t, g, unknown or other
  modified_base (765)..(765): a, c, t, g, unknown or other
  modified_base (774)..(774): a, c, t, g, unknown or other
  modified_base (777)..(777): a, c, t, g, unknown or other
  modified_base (780)..(780): a, c, t, g, unknown or other
  modified_base (783)..(783): a, c, t, g, unknown or other
  modified_base (786)..(786): a, c, t, g, unknown or other
  modified_base (789)..(789): a, c, t, g, unknown or other
  modified_base (792)..(792): a, c, t, g, unknown or other
  modified_base (795)..(795): a, c, t, g, unknown or other
  modified_base (798)..(798): a, c, t, g, unknown or other
  modified_base (801)..(801): a, c, t, g, unknown or other
  modified_base (807)..(807): a, c, t, g, unknown or other
  modified_base (813)..(813): a, c, t, g, unknown or other
  modified_base (819)..(819): a, c, t, g, unknown or other
  modified_base (822)..(822): a, c, t, g, unknown or other
  modified_base (828)..(828): a, c, t, g, unknown or other
  modified_base (831)..(831): a, c, t, g, unknown or other
  modified_base (834)..(834): a, c, t, g, unknown or other
  modified_base (846)..(846): a, c, t, g, unknown or other
  modified_base (849)..(849): a, c, t, g, unknown or other
  modified_base (852)..(852): a, c, t, g, unknown or other
  modified_base (855)..(855): a, c, t, g, unknown or other
  modified_base (861)..(861): a, c, t, g, unknown or other
  modified_base (867)..(867): a, c, t, g, unknown or other
  modified_base (870)..(870): a, c, t, g, unknown or other
  modified_base (873)..(873): a, c, t, g, unknown or other
  modified_base (876)..(876): a, c, t, g, unknown or other
  modified_base (879)..(879): a, c, t, g, unknown or other
  modified_base (885)..(885): a, c, t, g, unknown or other
  modified_base (888)..(888): a, c, t, g, unknown or other
  modified_base (891)..(891): a, c, t, g, unknown or other
  modified_base (894)..(894): a, c, t, g, unknown or other
  modified_base (897)..(897): a, c, t, g, unknown or other
  modified_base (906)..(906): a, c, t, g, unknown or other
  modified_base (909)..(909): a, c, t, g, unknown or other
  modified_base (912)..(912): a, c, t, g, unknown or other
  modified_base (915)..(915): a, c, t, g, unknown or other
  modified_base (921)..(921): a, c, t, g, unknown or other
  modified_base (924)..(924): a, c, t, g, unknown or other
  modified_base (930)..(930): a, c, t, g, unknown or other
  modified_base (933)..(933): a, c, t, g, unknown or other
  modified_base (936)..(936): a, c, t, g, unknown or other
  modified_base (942)..(942): a, c, t, g, unknown or other
  modified_base (951)..(951): a, c, t, g, unknown or other
  modified_base (954)..(954): a, c, t, g, unknown or other
  modified_base (960)..(960): a, c, t, g, unknown or other
  modified_base (969)..(969): a, c, t, g, unknown or other
  modified_base (972)..(972): a, c, t, g, unknown or other
  modified_base (978)..(978): a, c, t, g, unknown or other
  modified_base (981)..(981): a, c, t, g, unknown or other
  modified_base (987)..(987): a, c, t, g, unknown or other
  modified_base (990)..(990): a, c, t, g, unknown or other
  modified_base (996)..(996): a, c, t, g, unknown or other
  modified_base (999)..(999): a, c, t, g, unknown or other
  modified_base (1002)..(1002): a, c, t, g, unknown or other
  modified_base (1005)..(1005): a, c, t, g, unknown or other
  modified_base (1008)..(1008): a, c, t, g, unknown or other
  modified_base (1020)..(1020): a, c, t, g, unknown or other
  modified_base (1023)..(1023): a, c, t, g, unknown or other
  modified_base (1029)..(1029): a, c, t, g, unknown or other
  modified_base (1032)..(1032): a, c, t, g, unknown or other
  modified_base (1035)..(1035): a, c, t, g, unknown or other
  modified_base (1041)..(1041): a, c, t, g, unknown or other
  modified_base (1047)..(1047): a, c, t, g, unknown or other
  modified_base (1053)..(1053): a, c, t, g, unknown or other
  modified_base (1062)..(1062): a, c, t, g, unknown or other
  modified_base (1065)..(1065): a, c, t, g, unknown or other
  modified_base (1071)..(1071): a, c, t, g, unknown or other
  modified_base (1077)..(1077): a, c, t, g, unknown or other
  modified_base (1080)..(1080): a, c, t, g, unknown or other
  modified_base (1089)..(1089): a, c, t, g, unknown or other
  modified_base (1092)..(1092): a, c, t, g, unknown or other
  modified_base (1098)..(1098): a, c, t, g, unknown or other
  modified_base (1104)..(1104): a, c, t, g, unknown or other
  modified_base (1107)..(1107): a, c, t, g, unknown or other
  modified_base (1113)..(1113): a, c, t, g, unknown or other
  modified_base (1119)..(1119): a, c, t, g, unknown or other
  modified_base (1125)..(1125): a, c, t, g, unknown or other
  modified_base (1128)..(1128): a, c, t, g, unknown or other
  modified_base (1131)..(1131): a, c, t, g, unknown or other
  modified_base (1134)..(1134): a, c, t, g, unknown or other
  modified_base (1137)..(1137): a, c, t, g, unknown or other
  modified_base (1140)..(1140): a, c, t, g, unknown or other
  modified_base (1143)..(1143): a, c, t, g, unknown or other
  modified_base (1152)..(1152): a, c, t, g, unknown or other
  modified_base (1158)..(1158): a, c, t, g, unknown or other
  modified_base (1167)..(1167): a, c, t, g, unknown or other
  modified_base (1170)..(1170): a, c, t, g, unknown or other
  modified_base (1182)..(1182): a, c, t, g, unknown or other
  modified_base (1185)..(1185): a, c, t, g, unknown or other
  modified_base (1191)..(1191): a, c, t, g, unknown or other
  modified_base (1194)..(1194): a, c, t, g, unknown or other
  modified_base (1197)..(1197): a, c, t, g, unknown or other
  modified_base (1200)..(1200): a, c, t, g, unknown or other
  modified_base (1206)..(1206): a, c, t, g, unknown or other
  modified_base (1212)..(1212): a, c, t, g, unknown or other
  modified_base (1227)..(1227): a, c, t, g, unknown or other
  modified_base (1233)..(1233): a, c, t, g, unknown or other
  modified_base (1236)..(1236): a, c, t, g, unknown or other
  modified_base (1239)..(1239): a, c, t, g, unknown or other
  modified_base (1242)..(1242): a, c, t, g, unknown or other
  modified_base (1248)..(1248): a, c, t, g, unknown or other
  modified_base (1254)..(1254): a, c, t, g, unknown or other
  modified_base (1257)..(1257): a, c, t, g, unknown or other
  modified_base (1260)..(1260): a, c, t, g, unknown or other
  modified_base (1263)..(1263): a, c, t, g, unknown or other
  modified_base (1266)..(1266): a, c, t, g, unknown or other
  modified_base (1269)..(1269): a, c, t, g, unknown or other
  modified_base (1275)..(1275): a, c, t, g, unknown or other
  modified_base (1278)..(1278): a, c, t, g, unknown or other
  modified_base (1281)..(1281): a, c, t, g, unknown or other
  modified_base (1284)..(1284): a, c, t, g, unknown or other
  modified_base (1287)..(1287): a, c, t, g, unknown or other
  modified_base (1290)..(1290): a, c, t, g, unknown or other
  modified_base (1293)..(1293): a, c, t, g, unknown or other
  modified_base (1296)..(1296): a, c, t, g, unknown or other
  modified_base (1305)..(1305): a, c, t, g, unknown or other
  modified_base (1308)..(1308): a, c, t, g, unknown or other
  modified_base (1311)..(1311): a, c, t, g, unknown or other
  modified_base (1314)..(1314): a, c, t, g, unknown or other
  modified_base (1317)..(1317): a, c, t, g, unknown or other
  modified_base (1320)..(1320): a, c, t, g, unknown or other
  modified_base (1323)..(1323): a, c, t, g, unknown or other
  modified_base (1326)..(1326): a, c, t, g, unknown or other
  modified_base (1329)..(1329): a, c, t, g, unknown or other
  modified_base (1335)..(1335): a, c, t, g, unknown or other
  modified_base (1338)..(1338): a, c, t, g, unknown or other
  modified_base (1341)..(1341): a, c, t, g, unknown or other
  modified_base (1347)..(1347): a, c, t, g, unknown or other
  modified_base (1353)..(1353): a, c, t, g, unknown or other
  modified_base (1356)..(1356): a, c, t, g, unknown or other
  modified_base (1362)..(1362): a, c, t, g, unknown or other
  modified_base (1368)..(1368): a, c, t, g, unknown or other
  modified_base (1371)..(1371): a, c, t, g, unknown or other
  modified_base (1374)..(1374): a, c, t, g, unknown or other
  modified_base (1377)..(1377): a, c, t, g, unknown or other
  modified_base (1380)..(1380): a, c, t, g, unknown or other
  modified_base (1383)..(1383): a, c, t, g, unknown or other
  modified_base (1389)..(1389): a, c, t, g, unknown or other
  modified_base (1395)..(1395): a, c, t, g, unknown or other
  modified_base (1398)..(1398): a, c, t, g, unknown or other
  modified_base (1401)..(1401): a, c, t, g, unknown or other
  modified_base (1413)..(1413): a, c, t, g, unknown or other
  modified_base (1416)..(1416): a, c, t, g, unknown or other
  modified_base (1419)..(1419): a, c, t, g, unknown or other
  modified_base (1422)..(1422): a, c, t, g, unknown or other
  modified_base (1425)..(1425): a, c, t, g, unknown or other
  modified_base (1428)..(1428): a, c, t, g, unknown or other
  modified_base (1434)..(1434): a, c, t, g, unknown or other
  modified_base (1437)..(1437): a, c, t, g, unknown or other
  modified_base (1443)..(1443): a, c, t, g, unknown or other
  modified_base (1446)..(1446): a, c, t, g, unknown or other
  modified_base (1449)..(1449): a, c, t, g, unknown or other
  modified_base (1455)..(1455): a, c, t, g, unknown or other
  modified_base (1458)..(1458): a, c, t, g, unknown or other
  modified_base (1461)..(1461): a, c, t, g, unknown or other
  modified_base (1464)..(1464): a, c, t, g, unknown or other
  modified_base (1470)..(1470): a, c, t, g, unknown or other
  modified_base (1473)..(1473): a, c, t, g, unknown or other
  modified_base (1476)..(1476): a, c, t, g, unknown or other
  modified_base (1482)..(1482): a, c, t, g, unknown or other
  modified_base (1485)..(1485): a, c, t, g, unknown or other
  modified_base (1491)..(1491): a, c, t, g, unknown or other
  modified_base (1494)..(1494): a, c, t, g, unknown or other
  modified_base (1500)..(1500): a, c, t, g, unknown or other
  modified_base (1503)..(1503): a, c, t, g, unknown or other
  modified_base (1506)..(1506): a, c, t, g, unknown or other
  modified_base (1512)..(1512): a, c, t, g, unknown or other
  modified_base (1518)..(1518): a, c, t, g, unknown or other
  modified_base (1521)..(1521): a, c, t, g, unknown or other
  modified_base (1524)..(1524): a, c, t, g, unknown or other
  modified_base (1530)..(1530): a, c, t, g, unknown or other
  modified_base (1545)..(1545): a, c, t, g, unknown or other
  modified_base (1551)..(1551): a, c, t, g, unknown or other
  modified_base (1554)..(1554): a, c, t, g, unknown or other
  modified_base (1557)..(1557): a, c, t, g, unknown or other
  modified_base (1560)..(1560): a, c, t, g, unknown or other
  modified_base (1569)..(1569): a, c, t, g, unknown or other
  modified_base (1572)..(1572): a, c, t, g, unknown or other
  modified_base (1578)..(1578): a, c, t, g, unknown or other
  modified_base (1581)..(1581): a, c, t, g, unknown or other
  modified_base (1587)..(1587): a, c, t, g, unknown or other
  modified_base (1590)..(1590): a, c, t, g, unknown or other
  modified_base (1593)..(1593): a, c, t, g, unknown or other
  modified_base (1602)..(1602): a, c, t, g, unknown or other
gcngcngcngtngtnwsncayttyaaygaytgyccngaywsncayacncarttytgyttycayggnacntgymgnttyytngtncargargayaarccngcntgygtntgycaywsnggntaygtnggngcnmgntgygarcaygcngayytnytngcngcnatggcngargarggnggnwsnytngcngcnytnacngcncaycargcntgycayytnccnytngaracnttyacnmgncaymgncarccnmgnggntgggarcarytngarcartgyggntayccngtncarmgnytngtngcnytntayytngcngcnmgnytnwsntggaaycargtngaycargcngcngcngtngtnwsncayttyaaygaytgyccngaywsncayacncarttytgyttycayggnacntgymgnttyytngtncargargayaarccngcntgygtntgycaywsnggntaygtnggngcnmgntgygarcaygcngayytnytngcngcnatggcngargarggnggnwsnytngcngcnytnacngcncaycargcngcncayytnccnytngaracnytnacnmgncaymgncarccnmgnggntgggarcarytngarcargcnggntayccngtncarmgnytngtngcnytntayytngcngcnmgnytnwsntggaaycargtngaycargtnathmgnaaygcnytngcnwsnccnggnwsnggnggngayytnggngargcnathmgngarcarccngarcargcnmgnytngcnytnacnytngcngcngcngarwsngarmgnttygtnmgncarggnacnggnaaygaygargcnggngcngcnaaygcngaygtngtnwsnytnacntgyccngtngcngcnggngartgygcnggnccngcngaywsnggngaygcnytnytngarmgnaaytayccnacngargcngarttyytnggngayggnggngaygtnwsnttywsnacnmgnggnacncaraaytggacngtngarmgnytnytncargcncaymgncarytngargarmgnggntaygtnttygtnggntaycayggnacnttyytngargcngcncarwsnathgtnttyggnggngtnmgngcnmgnwsncargayytngaygcnathtggmgnggnttytayathgcnggngayccngcnytngcntayggntaygcncargaycargarccngaygcnmgnggnmgnathmgnaayggngcnytnytnmgngtntaygtnccnmgnwsnwsnytnccnggnttytaymgnacnwsnytnacnytngcngcnccngargcngcnggngargtngarmgnytnathggncayccnytnccnytnmgnytngaygcnathacnggnccngargargarggnggngcnytngcnacnathytnggntggccnytngcngarmgnacngtngtnathccnwsngcnathccnacngayccnmgnaaygtnggnggngayytngayccnwsnwsnathccngayaargarcargcnathwsngcnytnccngaytaygcnwsncarccnggnaarccnccnmgngargayytnaar

SEQ ID NO: 54 - DNA, 1257 bp, Artificial Sequence
  source: /note="Description of Artificial Sequence: Synthetic polynucleotide"
  source: /note="PE ribotoxic region polynucleotide variant 5"
  modified_base (3)..(3): a, c, t, g, unknown or other
  modified_base (6)..(6): a, c, t, g, unknown or other
  modified_base (9)..(9): a, c, t, g, unknown or other
  modified_base (12)..(12): a, c, t, g, unknown or other
  modified_base (15)..(15): a, c, t, g, unknown or other
  modified_base (18)..(18): a, c, t, g, unknown or other
  modified_base (36)..(36): a, c, t, g, unknown or other
  modified_base (42)..(42): a, c, t, g, unknown or other
  modified_base (48)..(48): a, c, t, g, unknown or other
  modified_base (66)..(66): a, c, t, g, unknown or other
  modified_base (69)..(69): a, c, t, g, unknown or other
  modified_base (75)..(75): a, c, t, g, unknown or other
  modified_base (81)..(81): a, c, t, g, unknown or other
  modified_base (84)..(84): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (126)..(126): a, c, t, g, unknown or other
  modified_base (129)..(129): a, c, t, g, unknown or other
  modified_base (132)..(132): a, c, t, g, unknown or other
  modified_base (135)..(135): a, c, t, g, unknown or other
  modified_base (147)..(147): a, c, t, g, unknown or other
  modified_base (153)..(153): a, c, t, g, unknown or other
  modified_base (156)..(156): a, c, t, g, unknown or other
  modified_base (159)..(159): a, c, t, g, unknown or other
  modified_base (162)..(162): a, c, t, g, unknown or other
  modified_base (168)..(168): a, c, t, g, unknown or other
  modified_base (177)..(177): a, c, t, g, unknown or other
  modified_base (180)..(180): a, c, t, g, unknown or other
  modified_base (183)..(183): a, c, t, g, unknown or other
  modified_base (186)..(186): a, c, t, g, unknown or other
  modified_base (189)..(189): a, c, t, g, unknown or other
  modified_base (192)..(192): a, c, t, g, unknown or other
  modified_base (195)..(195): a, c, t, g, unknown or other
  modified_base (198)..(198): a, c, t, g, unknown or other
  modified_base (201)..(201): a, c, t, g, unknown or other
  modified_base (210)..(210): a, c, t, g, unknown or other
  modified_base (219)..(219): a, c, t, g, unknown or other
  modified_base (222)..(222): a, c, t, g, unknown or other
  modified_base (225)..(225): a, c, t, g, unknown or other
  modified_base (231)..(231): a, c, t, g, unknown or other
  modified_base (237)..(237): a, c, t, g, unknown or other
  modified_base (240)..(240): a, c, t, g, unknown or other
  modified_base (246)..(246): a, c, t, g, unknown or other
  modified_base (252)..(252): a, c, t, g, unknown or other
  modified_base (255)..(255): a, c, t, g, unknown or other
  modified_base (258)..(258): a, c, t, g, unknown or other
  modified_base (270)..(270): a, c, t, g, unknown or other
  modified_base (282)..(282): a, c, t, g, unknown or other
  modified_base (288)..(288): a, c, t, g, unknown or other
  modified_base (291)..(291): a, c, t, g, unknown or other
  modified_base (297)..(297): a, c, t, g, unknown or other
  modified_base (300)..(300): a, c, t, g, unknown or other
  modified_base (303)..(303): a, c, t, g, unknown or other
  modified_base (306)..(306): a, c, t, g, unknown or other
  modified_base (309)..(309): a, c, t, g, unknown or other
  modified_base (315)..(315): a, c, t, g, unknown or other
  modified_base (318)..(318): a, c, t, g, unknown or other
  modified_base (321)..(321): a, c, t, g, unknown or other
  modified_base (324)..(324): a, c, t, g, unknown or other
  modified_base (327)..(327): a, c, t, g, unknown or other
  modified_base (330)..(330): a, c, t, g, unknown or other
  modified_base (342)..(342): a, c, t, g, unknown or other
  modified_base (351)..(351): a, c, t, g, unknown or other
  modified_base (357)..(357): a, c, t, g, unknown or other
  modified_base (363)..(363): a, c, t, g, unknown or other
  modified_base (366)..(366): a, c, t, g, unknown or other
  modified_base (369)..(369): a, c, t, g, unknown or other
  modified_base (372)..(372): a, c, t, g, unknown or other
  modified_base (375)..(375): a, c, t, g, unknown or other
  modified_base (378)..(378): a, c, t, g, unknown or other
  modified_base (381)..(381): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (396)..(396): a, c, t, g, unknown or other
  modified_base (402)..(402): a, c, t, g, unknown or other
  modified_base (408)..(408): a, c, t, g, unknown or other
  modified_base (417)..(417): a, c, t, g, unknown or other
  modified_base (426)..(426): a, c, t, g, unknown or other
  modified_base (429)..(429): a, c, t, g, unknown or other
  modified_base (432)..(432): a, c, t, g, unknown or other
  modified_base (435)..(435): a, c, t, g, unknown or other
  modified_base (438)..(438): a, c, t, g, unknown or other
  modified_base (441)..(441): a, c, t, g, unknown or other
  modified_base (444)..(444): a, c, t, g, unknown or other
  modified_base (447)..(447): a, c, t, g, unknown or other
  modified_base (450)..(450): a, c, t, g, unknown or other
  modified_base (453)..(453): a, c, t, g, unknown or other
  modified_base (459)..(459): a, c, t, g, unknown or other
  modified_base (465)..(465): a, c, t, g, unknown or other
  modified_base (471)..(471): a, c, t, g, unknown or other
  modified_base (474)..(474): a, c, t, g, unknown or other
  modified_base (480)..(480): a, c, t, g, unknown or other
  modified_base (483)..(483): a, c, t, g, unknown or other
  modified_base (486)..(486): a, c, t, g, unknown or other
  modified_base (498)..(498): a, c, t, g, unknown or other
  modified_base (501)..(501): a, c, t, g, unknown or other
  modified_base (504)..(504): a, c, t, g, unknown or other
  modified_base (507)..(507): a, c, t, g, unknown or other
  modified_base (513)..(513): a, c, t, g, unknown or other
  modified_base (519)..(519): a, c, t, g, unknown or other
  modified_base (522)..(522): a, c, t, g, unknown or other
  modified_base (525)..(525): a, c, t, g, unknown or other
  modified_base (528)..(528): a, c, t, g, unknown or other
  modified_base (531)..(531): a, c, t, g, unknown or other
  modified_base (534)..(534): a, c, t, g, unknown or other
  modified_base (537)..(537): a, c, t, g, unknown or other
  modified_base (540)..(540): a, c, t, g, unknown or other
  modified_base (543)..(543): a, c, t, g, unknown or other
  modified_base (546)..(546): a, c, t, g, unknown or other
  modified_base (549)..(549): a, c, t, g, unknown or other
  modified_base (555)..(555): a, c, t, g, unknown or other
  modified_base (558)..(558): a, c, t, g, unknown or other
  modified_base (561)..(561): a, c, t, g, unknown or other
  modified_base (564)..(564): a, c, t, g, unknown or other
  modified_base (567)..(567): a, c, t, g, unknown or other
  modified_base (573)..(573): a, c, t, g, unknown or other
  modified_base (576)..(576): a, c, t, g, unknown or other
  modified_base (582)..(582): a, c, t, g, unknown or other
  modified_base (585)..(585): a, c, t, g, unknown or other
  modified_base (588)..(588): a, c, t, g, unknown or other
  modified_base (594)..(594): a, c, t, g, unknown or other
  modified_base (603)..(603): a, c, t, g, unknown or other
  modified_base (606)..(606): a, c, t, g, unknown or other
  modified_base (609)..(609): a, c, t, g, unknown or other
  modified_base (612)..(612): a, c, t, g, unknown or other
  modified_base (621)..(621): a, c, t, g, unknown or other
  modified_base (624)..(624): a, c, t, g, unknown or other
  modified_base (630)..(630): a, c, t, g, unknown or other
  modified_base (633)..(633): a, c, t, g, unknown or other
  modified_base (639)..(639): a, c, t, g, unknown or other
  modified_base (642)..(642): a, c, t, g, unknown or other
  modified_base (648)..(648): a, c, t, g, unknown or other
  modified_base (651)..(651): a, c, t, g, unknown or other
  modified_base (654)..(654): a, c, t, g, unknown or other
  modified_base (657)..(657): a, c, t, g, unknown or other
  modified_base (660)..(660): a, c, t, g, unknown or other
  modified_base (672)..(672): a, c, t, g, unknown or other
  modified_base (675)..(675): a, c, t, g, unknown or other
  modified_base (681)..(681): a, c, t, g, unknown or other
  modified_base (684)..(684): a, c, t, g, unknown or other
  modified_base (687)..(687): a, c, t, g, unknown or other
  modified_base (693)..(693): a, c, t, g, unknown or other
  modified_base (699)..(699): a, c, t, g, unknown or other
  modified_base (705)..(705): a, c, t, g, unknown or other
  modified_base (714)..(714): a, c, t, g, unknown or other
  modified_base (717)..(717): a, c, t, g, unknown or other
  modified_base (723)..(723): a, c, t, g, unknown or other
  modified_base (729)..(729): a, c, t, g, unknown or other
  modified_base (732)..(732): a, c, t, g, unknown or other
  modified_base (741)..(741): a, c, t, g, unknown or other
  modified_base (744)..(744): a, c, t, g, unknown or other
  modified_base (750)..(750): a, c, t, g, unknown or other
  modified_base (756)..(756): a, c, t, g, unknown or other
  modified_base (759)..(759): a, c, t, g, unknown or other
  modified_base (765)..(765): a, c, t, g, unknown or other
  modified_base (771)..(771): a, c, t, g, unknown or other
  modified_base (777)..(777): a, c, t, g, unknown or other
  modified_base (780)..(780): a, c, t, g, unknown or other
  modified_base (783)..(783): a, c, t, g, unknown or other
  modified_base (786)..(786): a, c, t, g, unknown or other
  modified_base (789)..(789): a, c, t, g, unknown or other
  modified_base (792)..(792): a, c, t, g, unknown or other
  modified_base (795)..(795): a, c, t, g, unknown or other
  modified_base (804)..(804): a, c, t, g, unknown or other
  modified_base (810)..(810): a, c, t, g, unknown or other
  modified_base (819)..(819): a, c, t, g, unknown or other
  modified_base (822)..(822): a, c, t, g, unknown or other
  modified_base (834)..(834): a, c, t, g, unknown or other
  modified_base (837)..(837): a, c, t, g, unknown or other
  modified_base (843)..(843): a, c, t, g, unknown or other
  modified_base (846)..(846): a, c, t, g, unknown or other
  modified_base (849)..(849): a, c, t, g, unknown or other
  modified_base (852)..(852): a, c, t, g, unknown or other
  modified_base (858)..(858): a, c, t, g, unknown or other
  modified_base (864)..(864): a, c, t, g, unknown or other
  modified_base (879)..(879): a, c, t, g, unknown or other
  modified_base (885)..(885): a, c, t, g, unknown or other
  modified_base (888)..(888): a, c, t, g, unknown or other
  modified_base (891)..(891): a, c, t, g, unknown or other
  modified_base (894)..(894): a, c, t, g, unknown or other
  modified_base (900)..(900): a, c, t, g, unknown or other
  modified_base (906)..(906): a, c, t, g, unknown or other
  modified_base (909)..(909): a, c, t, g, unknown or other
  modified_base (912)..(912): a, c, t, g, unknown or other
  modified_base (915)..(915): a, c, t, g, unknown or other
  modified_base (918)..(918): a, c, t, g, unknown or other
  modified_base (921)..(921): a, c, t, g, unknown or other
  modified_base (927)..(927): a, c, t, g, unknown or other
  modified_base (930)..(930): a, c, t, g, unknown or other
  modified_base (933)..(933): a, c, t, g, unknown or other
  modified_base (936)..(936): a, c, t, g, unknown or other
  modified_base (939)..(939): a, c, t, g, unknown or other
  modified_base (942)..(942): a, c, t, g, unknown or other
  modified_base (945)..(945): a, c, t, g, unknown or other
  modified_base (948)..(948): a, c, t, g, unknown or other
  modified_base (957)..(957): a, c, t, g, unknown or other
  modified_base (960)..(960): a, c, t, g, unknown or other
  modified_base (963)..(963): a, c, t, g, unknown or other
  modified_base (966)..(966): a, c, t, g, unknown or other
  modified_base (969)..(969): a, c, t, g, unknown or other
  modified_base (972)..(972): a, c, t, g, unknown or other
  modified_base (975)..(975): a, c, t, g, unknown or other
  modified_base (978)..(978): a, c, t, g, unknown or other
  modified_base (981)..(981): a, c, t, g, unknown or other
  modified_base (987)..(987): a, c, t, g, unknown or other
  modified_base (990)..(990): a, c, t, g, unknown or other
  modified_base (993)..(993): a, c, t, g, unknown or other
  modified_base (999)..(999): a, c, t, g, unknown or other
  modified_base (1005)..(1005): a, c, t, g, unknown or other
  modified_base (1008)..(1008): a, c, t, g, unknown or other
  modified_base (1014)..(1014): a, c, t, g, unknown or other
  modified_base (1020)..(1020): a, c, t, g, unknown or other
  modified_base (1023)..(1023): a, c, t, g, unknown or other
  modified_base (1026)..(1026): a, c, t, g, unknown or other
  modified_base (1029)..(1029): a, c, t, g, unknown or other
  modified_base (1032)..(1032): a, c, t, g, unknown or other
  modified_base (1035)..(1035): a, c, t, g, unknown or other
  modified_base (1041)..(1041): a, c, t, g, unknown or other
  modified_base (1047)..(1047): a, c, t, g, unknown or other
  modified_base (1050)..(1050): a, c, t, g, unknown or other
  modified_base (1053)..(1053): a, c, t, g, unknown or other
  modified_base (1065)..(1065): a, c, t, g, unknown or other
  modified_base (1068)..(1068): a, c, t, g, unknown or other
  modified_base (1071)..(1071): a, c, t, g, unknown or other
  modified_base (1074)..(1074): a, c, t, g, unknown or other
  modified_base (1077)..(1077): a, c, t, g, unknown or other
  modified_base (1080)..(1080): a, c, t, g, unknown or other
  modified_base (1086)..(1086): a, c, t, g, unknown or other
  modified_base (1089)..(1089): a, c, t, g, unknown or other
  modified_base (1095)..(1095): a, c, t, g, unknown or other
  modified_base (1098)..(1098): a, c, t, g, unknown or other
  modified_base (1101)..(1101): a, c, t, g, unknown or other
  modified_base (1107)..(1107): a, c, t, g, unknown or other
  modified_base (1110)..(1110): a, c, t, g, unknown or other
  modified_base (1113)..(1113): a, c, t, g, unknown or other
  modified_base (1116)..(1116): a, c, t, g, unknown or other
  modified_base (1122)..(1122): a, c, t, g, unknown or other
  modified_base (1125)..(1125): a, c, t, g, unknown or other
  modified_base (1128)..(1128): a, c, t, g, unknown or other
  modified_base (1134)..(1134): a, c, t, g, unknown or other
  modified_base (1137)..(1137): a, c, t, g, unknown or other
  modified_base (1143)..(1143): a, c, t, g, unknown or other
  modified_base (1146)..(1146): a, c, t, g, unknown or other
  modified_base (1152)..(1152): a, c, t, g, unknown or other
  modified_base (1155)..(1155): a, c, t, g, unknown or other
  modified_base (1158)..(1158): a, c, t, g, unknown or other
  modified_base (1164)..(1164): a, c, t, g, unknown or other
  modified_base (1170)..(1170): a, c, t, g, unknown or other
  modified_base (1173)..(1173): a, c, t, g, unknown or other
  modified_base (1176)..(1176): a, c, t, g, unknown or other
  modified_base (1182)..(1182): a, c, t, g, unknown or other
  modified_base (1197)..(1197): a, c, t, g, unknown or other
  modified_base (1203)..(1203): a, c, t, g, unknown or other
  modified_base (1206)..(1206): a, c, t, g, unknown or other
  modified_base (1209)..(1209): a, c, t, g, unknown or other
  modified_base (1212)..(1212): a, c, t, g, unknown or other
  modified_base (1221)..(1221): a, c, t, g, unknown or other
  modified_base (1224)..(1224): a, c, t, g, unknown or other
  modified_base (1230)..(1230): a, c, t, g, unknown or other
  modified_base (1233)..(1233): a, c, t, g, unknown or other
  modified_base (1239)..(1239): a, c, t, g, unknown or other
  modified_base (1242)..(1242): a, c, t, g, unknown or other
  modified_base (1245)..(1245): a, c, t, g, unknown or other
  modified_base (1254)..(1254): a, c, t, g, unknown or other
gcngcngcngtngtnwsncayttyaaygaytgyccngaywsncayacncarttytgyttycayggnacntgymgnttyytngtncargargayaarccngcntgygtntgycaywsnggntaygtnggngcnmgntgygarcaygcngayytnytngcngcnatggcngargarggnggnwsnytngcngcnytnacngcncaycargcntgycayytnccnytngaracnttyacnmgncaymgncarccnmgnggntgggarcarytngarcartgyggntayccngtncarmgnytngtngcnytntayytngcngcnmgnytnwsntggaaycargtngaycargtnathmgnaaygcnytngcnwsnccnggnwsnggnggngayytnggngargcnathmgngarcarccngarcargcnmgnytngcnytnacnytngcngcngcngarwsngarmgnttygtnmgncarggnacnggnaaygaygargcnggngcngcnaaygcngaygtngtnacnytnacngcnccngtngcngcnggngargcngcnggnccngcngaywsnggngaygcnytnytngarmgnaaytayccnacnggngcngarttyytnggngayggnggngaygtnwsnttywsnacnmgnggnacncaraaytggacngtngarmgnytnytncargcncaymgncarytngargarmgnggntaygtnttygtnggntaycayggnacnttyytngargcngcncarwsnathgtnttyggnggngtnmgngcnmgnwsncargayytngaygcnathtggmgnggnttytayathgcnggngayccngcnytngcntayggntaygcncargaycargarccngaygcnmgnggnmgnathmgnaayggngcnytnytnmgngtntaygtnccnmgnwsnwsnytnccnggnttytaymgnacnwsnytnacnytngcngcnccngargcngcnggngargtngarmgnytnathggncayccnytnccnytnmgnytngaygcnathacnggnccngargargarggnggngcnytngcnacnathytnggntggccnytngcngarmgnacngtngtnathccnwsngcnathccnacngayccnmgnaaygtnggnggngayytngayccnwsnwsnathccngayaargarcargcnathwsngcnytnccngaytaygcnwsncarccnggnaarccnccnmgngargayytnaar

SEQ ID NO: 55 - DNA, 1257 bp, Artificial Sequence
  source: /note="Description of Artificial Sequence: Synthetic polynucleotide"
  source: /note="PE ribotoxic region polynucleotide variant 6 (PE40)"
  modified_base (3)..(3): a, c, t, g, unknown or other
  modified_base (6)..(6): a, c, t, g, unknown or other
  modified_base (9)..(9): a, c, t, g, unknown or other
  modified_base (12)..(12): a, c, t, g, unknown or other
  modified_base (15)..(15): a, c, t, g, unknown or other
  modified_base (18)..(18): a, c, t, g, unknown or other
  modified_base (36)..(36): a, c, t, g, unknown or other
  modified_base (42)..(42): a, c, t, g, unknown or other
  modified_base (48)..(48): a, c, t, g, unknown or other
  modified_base (66)..(66): a, c, t, g, unknown or other
  modified_base (69)..(69): a, c, t, g, unknown or other
  modified_base (75)..(75): a, c, t, g, unknown or other
  modified_base (81)..(81): a, c, t, g, unknown or other
  modified_base (84)..(84): a, c, t, g, unknown or other
  modified_base (99)..(99): a, c, t, g, unknown or other
  modified_base (102)..(102): a, c, t, g, unknown or other
  modified_base (108)..(108): a, c, t, g, unknown or other
  modified_base (117)..(117): a, c, t, g, unknown or other
  modified_base (120)..(120): a, c, t, g, unknown or other
  modified_base (126)..(126): a, c, t, g, unknown or other
  modified_base (129)..(129): a, c, t, g, unknown or other
  modified_base (132)..(132): a, c, t, g, unknown or other
  modified_base (135)..(135): a, c, t, g, unknown or other
  modified_base (147)..(147): a, c, t, g, unknown or other
  modified_base (153)..(153): a, c, t, g, unknown or other
  modified_base (156)..(156): a, c, t, g, unknown or other
  modified_base (159)..(159): a, c, t, g, unknown or other
  modified_base (162)..(162): a, c, t, g, unknown or other
  modified_base (168)..(168): a, c, t, g, unknown or other
  modified_base (177)..(177): a, c, t, g, unknown or other
  modified_base (180)..(180): a, c, t, g, unknown or other
  modified_base (183)..(183): a, c, t, g, unknown or other
  modified_base (186)..(186): a, c, t, g, unknown or other
  modified_base (189)..(189): a, c, t, g, unknown or other
  modified_base (192)..(192): a, c, t, g, unknown or other
  modified_base (195)..(195): a, c, t, g, unknown or other
  modified_base (198)..(198): a, c, t, g, unknown or other
  modified_base (201)..(201): a, c, t, g, unknown or other
  modified_base (210)..(210): a, c, t, g, unknown or other
  modified_base (213)..(213): a, c, t, g, unknown or other
  modified_base (219)..(219): a, c, t, g, unknown or other
  modified_base (222)..(222): a, c, t, g, unknown or other
  modified_base (225)..(225): a, c, t, g, unknown or other
  modified_base (231)..(231): a, c, t, g, unknown or other
  modified_base (234)..(234): a, c, t, g, unknown or other
  modified_base (237)..(237): a, c, t, g, unknown or other
  modified_base (240)..(240): a, c, t, g, unknown or other
  modified_base (246)..(246): a, c, t, g, unknown or other
  modified_base (252)..(252): a, c, t, g, unknown or other
  modified_base (255)..(255): a, c, t, g, unknown or other
  modified_base (258)..(258): a, c, t, g, unknown or other
  modified_base (270)..(270): a, c, t, g, unknown or other
  modified_base (279)..(279): a, c, t, g, unknown or other
  modified_base (282)..(282): a, c, t, g, unknown or other
  modified_base (288)..(288): a, c, t, g, unknown or other
  modified_base (291)..(291): a, c, t, g, unknown or other
  modified_base (297)..(297): a, c, t, g, unknown or other
  modified_base (300)..(300): a, c, t, g, unknown or other
  modified_base (303)..(303): a, c, t, g, unknown or other
  modified_base (306)..(306): a, c, t, g, unknown or other
  modified_base (309)..(309): a, c, t, g, unknown or other
  modified_base (315)..(315): a, c, t, g, unknown or other
  modified_base (318)..(318): a, c, t, g, unknown or other
  modified_base (321)..(321): a, c, t, g, unknown or other
  modified_base (324)..(324): a, c, t, g, unknown or other
  modified_base (327)..(327): a, c, t, g, unknown or other
  modified_base (330)..(330): a, c, t, g, unknown or other
  modified_base (342)..(342): a, c, t, g, unknown or other
  modified_base (351)..(351): a, c, t, g, unknown or other
  modified_base (357)..(357): a, c, t, g, unknown or other
  modified_base (363)..(363): a, c, t, g, unknown or other
  modified_base (366)..(366): a, c, t, g, unknown or other
  modified_base (369)..(369): a, c, t, g, unknown or other
  modified_base (372)..(372): a, c, t, g, unknown or other
  modified_base (375)..(375): a, c, t, g, unknown or other
  modified_base (378)..(378): a, c, t, g, unknown or other
  modified_base (381)..(381): a, c, t, g, unknown or other
  modified_base (384)..(384): a, c, t, g, unknown or other
  modified_base (387)..(387): a, c, t, g, unknown or other
  modified_base (393)..(393): a, c, t, g, unknown or other
  modified_base (396)..(396): a, c, t, g, unknown or other
  modified_base (402)..(402): a, c, t, g, unknown or other
  modified_base (408)..(408): a, c, t, g, unknown or other
  modified_base (417)..(417): a, c, t, g, unknown or other
  modified_base (426)..(426): a, c, t, g, unknown or other
  modified_base (429)..(429): a, c, t, g, unknown or other
  modified_base (432)..(432): a, c, t, g, unknown or other
  modified_base (435)..(435): a, c, t, g, unknown or other
  modified_base (438)..(438): a, c, t, g, unknown or other
  modified_base (441)..(441): a, c, t, g, unknown or other
  modified_base (444)..(444): a, c, t, g, unknown or other
  modified_base (447)..(447): a, c, t, g, unknown or other
  modified_base (450)..(450): a, c, t, g, unknown or other
  modified_base (453)..(453): a, c, t, g, unknown or other
  modified_base (459)..(459): a, c, t, g, unknown or other
  modified_base (465)..(465): a, c, t, g, unknown or other
  modified_base (471)..(471): a, c, t, g, unknown or other
  modified_base (474)..(474): a, c, t, g, unknown or other
  modified_base (480)..(480): a, c, t, g, unknown or other
  modified_base (483)..(483): a, c, t, g, unknown or other
  modified_base (486)..(486): a, c, t, g, unknown or other
  modified_base (498)..(498): a, c, t, g, unknown or other
  modified_base (501)..(501): a, c, t, g, unknown or other
  modified_base (504)..(504): a, c, t, g, unknown or other
  modified_base (507)..(507): a, c, t, g, unknown or other
  modified_base (513)..(513): a, c, t, g, unknown or other
  modified_base (519)..(519): a, c, t, g, unknown or other
  modified_base (522)..(522): a, c, t, g, unknown or other
  modified_base (525)..(525): a, c, t, g, unknown or other
  modified_base (528)..(528): a, c, t, g, unknown or other
  modified_base (531)..(531): a, c, t, g, unknown or other
  modified_base (534)..(534): a, c, t, g, unknown or other
  modified_base (537)..(537): a, c, t, g, unknown or other
  modified_base (540)..(540): a, c, t, g, unknown or other
  modified_base (543)..(543): a, c, t, g, unknown or other
  modified_base (546)..(546): a, c, t, g, unknown or other
  modified_base (549)..(549): a, c, t, g, unknown or other
  modified_base (555)..(555): a, c, t, g, unknown or other
  modified_base (558)..(558): a, c, t, g, unknown or other
  modified_base (561)..(561): a, c, t, g, unknown or other
  modified_base (564)..(564): a, c, t, g, unknown or other
  modified_base (567)..(567): a, c, t, g, unknown or other
  modified_base (573)..(573): a, c, t, g, unknown or other
  modified_base (576)..(576): a, c, t, g, unknown or other
  modified_base (582)..(582): a, c, t, g, unknown or other
  modified_base (585)..(585): a, c, t, g, unknown or other
  modified_base (588)..(588): a, c, t, g, unknown or other
  modified_base (594)..(594): a, c, t, g, unknown or other
  modified_base (603)..(603): a, c, t, g, unknown or other
  modified_base (606)..(606): a, c, t, g, unknown or other
  modified_base (609)..(609): a, c, t, g, unknown or other
  modified_base (612)..(612): a, c, t, g, unknown or other
  modified_base (621)..(621): a, c, t, g, unknown or other
  modified_base (624)..(624): a, c, t, g, unknown or other
  modified_base (630)..(630): a, c, t, g, unknown or other
  modified_base (633)..(633): a, c, t, g, unknown or other
  modified_base (639)..(639): a, c, t, g, unknown or other
  modified_base (642)..(642): a, c, t, g, unknown or other
  modified_base (648)..(648): a, c, t, g, unknown or other
  modified_base (651)..(651): a, c, t, g, unknown or other
  modified_base (654)..(654): a, c, t, g, unknown or other
  modified_base (657)..(657): a, c, t, g, unknown or other
  modified_base (660)..(660): a, c, t, g, unknown or other
  modified_base (672)..(672): a, c, t, g, unknown or other
  modified_base (675)..(675): a, c, t, g, unknown or other
  modified_base (681)..(681): a, c, t, g, unknown or other
  modified_base (684)..(684): a, c, t, g, unknown or other
  modified_base (687)..(687): a, c, t, g, unknown or other
  modified_base (693)..(693): a, c, t, g, unknown or other
  modified_base (699)..(699): a, c, t, g, unknown or other
  modified_base (705)..(705): a, c, t, g, unknown or other
  modified_base (714)..(714): a, c, t, g, unknown or other
  modified_base (717)..(717): a, c, t, g, unknown or other
  modified_base (723)..(723): a, c, t, g, unknown or other
  modified_base (729)..(729): a, c, t, g, unknown or other
  modified_base (732)..(732): a, c, t, g, unknown or other
  modified_base (741)..(741): a, c, t, g, unknown or other
  modified_base (744)..(744): a, c, t, g, unknown or other
  modified_base (750)..(750): a, c, t, g, unknown or other
  modified_base (756)..(756): a, c, t, g, unknown or other
  modified_base (759)..(759): a, c, t, g, unknown or other
  modified_base (765)..(765): a, c, t, g, unknown or other
  modified_base (771)..(771): a, c, t, g, unknown or other
  modified_base (777)..(777): a, c, t, g, unknown or other
  modified_base (780)..(780): a, c, t, g, unknown or other
  modified_base (783)..(783): a, c, t, g, unknown or other
  modified_base (786)..(786): a, c, t, g, unknown or other
  modified_base (789)..(789): a, c, t, g, unknown or other
  modified_base (792)..(792): a, c, t, g, unknown or other
  modified_base (795)..(795): a, c, t, g, unknown or other
  modified_base (804)..(804): a, c, t, g, unknown or other
  modified_base (810)..(810): a, c, t, g, unknown or other
  modified_base (819)..(819): a, c, t, g, unknown or other
  modified_base (822)..(822): a, c, t, g, unknown or other
  modified_base (834)..(834): a, c, t, g, unknown or other
  modified_base (837)..(837): a, c, t, g, unknown or other
  modified_base (843)..(843): a, c, t, g, unknown or other
  modified_base (846)..(846): a, c, t, g, unknown or other
  modified_base (849)..(849): a, c, t, g, unknown or other
  modified_base (852)..(852): a, c, t, g, unknown or other
  modified_base (858)..(858): a, c, t, g, unknown or other
  modified_base (864)..(864): a, c, t, g, unknown or other
  modified_base (879)..(879): a, c, t, g, unknown or other
  modified_base (885)..(885): a, c, t, g, unknown or other
  modified_base (888)..(888): a, c, t, g, unknown or other
  modified_base (891)..(891): a, c, t, g, unknown or other
  modified_base (894)..(894): a, c, t, g, unknown or other
  modified_base (900)..(900): a, c, t, g, unknown or other
  modified_base (906)..(906): a, c, t, g, unknown or other
  modified_base (909)..(909): a, c, t, g, unknown or other
  modified_base (912)..(912): a, c, t, g, unknown or other
  modified_base (915)..(915): a, c, t, g, unknown or other
  modified_base (918)..(918): a, c, t, g, unknown or other
  modified_base (921)..(921): a, c, t, g, unknown or other
  modified_base (927)..(927): a, c, t, g, unknown or other
  modified_base (930)..(930): a, c, t, g, unknown or other
  modified_base (933)..(933): a, c, t, g, unknown or other
  modified_base (936)..(936): a, c, t, g, unknown or other
  modified_base (939)..(939): a, c, t, g, unknown or other
  modified_base (942)..(942): a, c, t, g, unknown or other
  modified_base (945)..(945): a, c, t, g, unknown or other
  modified_base (948)..(948): a, c, t, g, unknown or other
  modified_base (957)..(957): a, c, t, g, unknown or other
  modified_base (960)..(960): a, c, t, g, unknown or other
  modified_base (963)..(963): a, c, t, g, unknown or other
  modified_base (966)..(966): a, c, t, g, unknown or other
  modified_base (969)..(969): a, c, t, g, unknown or other
  modified_base (972)..(972): a, c, t, g, unknown or other
  modified_base (975)..(975): a, c, t, g, unknown or other
  modified_base (978)..(978): a, c, t, g, unknown or other
  modified_base (981)..(981): a, c, t, g, unknown or other
  modified_base (987)..(987): a, c, t, g, unknown or other
  modified_base (990)..(990): a, c, t, g, unknown or other
  modified_base (993)..(993): a, c, t, g, unknown or other
  modified_base (999)..(999): a, c, t, g, unknown or other
  modified_base (1005)..(1005): a, c, t, g, unknown or other
  modified_base (1008)..(1008): a, c, t, g, unknown or other
  modified_base (1014)..(1014): a, c, t, g, unknown or other
  modified_base (1020)..(1020): a, c, t, g, unknown or other
  modified_base (1023)..(1023): a, c, t, g, unknown or other
  modified_base (1026)..(1026): a, c, t, g, unknown or other
  modified_base (1029)..(1029): a, c, t, g, unknown or other
  modified_base (1032)..(1032): a, c, t, g, unknown or other
  modified_base (1035)..(1035): a, c, t, g, unknown or other
  modified_base (1041)..(1041): a, c, t, g, unknown or other
  modified_base (1047)..(1047): a, c, t, g, unknown or other
  modified_base (1050)..(1050): a, c, t, g, unknown or other
  modified_base (1053)..(1053): a, c, t, g, unknown or other
  modified_base (1065)..(1065): a, c, t, g, unknown or other
  modified_base (1068)..(1068): a, c, t, g, unknown or other
  modified_base (1071)..(1071): a, c, t, g, unknown or other
  modified_base (1074)..(1074): a, c, t, g, unknown or other
  modified_base (1077)..(1077): a, c, t, g, unknown or other
  modified_base (1080)..(1080): a, c, t, g, unknown or other
  modified_base (1086)..(1086): a, c, t, g, unknown or other
  modified_base (1089)..(1089): a, c, t, g, unknown or other
  modified_base (1095)..(1095): a, c, t, g, unknown or other
  modified_base (1098)..(1098): a, c, t, g, unknown or other
  modified_base (1101)..(1101): a, c, t, g, unknown or other
  modified_base (1107)..(1107): a, c, t, g, unknown or other
  modified_base (1110)..(1110): a, c, t, g, unknown or other
  modified_base (1113)..(1113): a, c, t, g, unknown or other
  modified_base (1116)..(1116): a, c, t, g, unknown or other
  modified_base (1122)..(1122): a, c, t, g, unknown or other
  modified_base (1125)..(1125): a, c, t, g, unknown or other
  modified_base (1128)..(1128): a, c, t, g, unknown or other
  modified_base (1134)..(1134): a, c, t, g, unknown or other
  modified_base (1137)..(1137): a, c, t, g, unknown or other
  modified_base (1143)..(1143): a, c, t, g, unknown or other
  modified_base (1146)..(1146): a, c, t, g, unknown or other
  modified_base (1152)..(1152): a, c, t, g, unknown or other
  modified_base (1155)..(1155): a, c, t, g, unknown or other
  modified_base (1158)..(1158): a, c, t, g, unknown or other
  modified_base (1164)..(1164): a, c, t, g, unknown or other
  modified_base (1170)..(1170): a, c, t, g, unknown or other
  modified_base (1173)..(1173): a, c, t, g, unknown or other
  modified_base (1176)..(1176): a, c, t, g, unknown or other
  modified_base (1182)..(1182): a, c, t, g, unknown or other
  modified_base (1197)..(1197): a, c, t, g, unknown or other
  modified_base (1203)..(1203): a, c, t, g, unknown or other
  modified_base (1206)..(1206): a, c, t, g, unknown or other
  modified_base (1209)..(1209): a, c, t, g, unknown or other
  modified_base (1212)..(1212): a, c, t, g, unknown or other
  modified_base (1221)..(1221): a, c, t, g, unknown or other
  modified_base (1224)..(1224): a, c, t, g, unknown or other
  modified_base (1230)..(1230): a, c, t, g, unknown or other
  modified_base (1233)..(1233): a, c, t, g, unknown or other
  modified_base (1239)..(1239): a, c, t, g, unknown or other
  modified_base (1242)..(1242): a, c, t, g, unknown or other
  modified_base (1245)..(1245): a, c, t, g, unknown or other
  modified_base (1254)..(1254): a, c, t, g, unknown or other
gcngcngcngtngtnwsncayttyaaygaytgyccngaywsncayacncarttytgyttycayggnacntgymgnttyytngtncargargayaarccngcntgygtntgycaywsnggntaygtnggngcnmgntgygarcaygcngayytnytngcngcnatggcngargarggnggnwsnytngcngcnytnacngcncaycargcngcncayytnccnytngaracnytnacnmgncaymgncarccnmgnggntgggarcarytngarcargcnggntayccngtncarmgnytngtngcnytntayytngcngcnmgnytnwsntggaaycargtngaycargtnathmgnaaygcnytngcnwsnccnggnwsnggnggngayytnggngargcnathmgngarcarccngarcargcnmgnytngcnytnacnytngcngcngcngarwsngarmgnttygtnmgncarggnacnggnaaygaygargcnggngcngcnaaygcngaygtngtnacnytnacngcnccngtngcngcnggngargcngcnggnccngcngaywsnggngaygcnytnytngarmgnaaytayccnacnggngcngarttyytnggngayggnggngaygtnwsnttywsnacnmgnggnacncaraaytggacngtngarmgnytnytncargcncaymgncarytngargarmgnggntaygtnttygtnggntaycayggnacnttyytngargcngcncarwsnathgtnttyggnggngtnmgngcnmgnwsncargayytngaygcnathtggmgnggnttytayathgcnggngayccngcnytngcntayggntaygcncargaycargarccngaygcnmgnggnmgnathmgnaayggngcnytnytnmgngtntaygtnccnmgnwsnwsnytnccnggnttytaymgnacnwsnytnacnytngcngcnccngargcngcnggngargtngarmgnytnathggncayccnytnccnytnmgnytngaygcnathacnggnccngargargarggnggngcnytngcnacnathytnggntggccnytngcngarmgnacngtngtnathccnwsngcnathccnacngayccnmgnaaygtnggnggngayytngayccnwsnwsnathccngayaargarcargcnathwsngcnytnccngaytaygcnwsncarccnggnaarccnccnmgngargayytnaar

SEQ ID NO: 56 - DNA, 1086 bp, Artificial Sequence
  source: /note="Description of Artificial Sequence: Synthetic polynucleotide"
  source: /note="PE ribotoxic region polynucleotide variant variant 7"
  modified_base (3)..(3): a, c, t, g, unknown or other
  modified_base (9)..(9): a, c, t, g, unknown or other
  modified_base (12)..(12): a, c, t, g, unknown or other
  modified_base (15)..(15): a, c, t, g, unknown or other
  modified_base (18)..(18): a, c, t, g, unknown or other
  modified_base (21)..(21): a, c, t, g, unknown or other
  modified_base (24)..(24): a, c, t, g, unknown or other
  modified_base (27)..(27): a, c, t, g, unknown or other
  modified_base (30)..(30): a, c, t, g, unknown or other
  modified_base (33)..(33): a, c, t, g, unknown or other
  modified_base (42)..(42): a, c, t, g, unknown or other
  modified_base (51)..(51): a, c, t, g, unknown or other
  modified_base (54)..(54): a, c, t, g, unknown or other
  modified_base (57)..(57): a, c, t, g, unknown or other
  modified_base (63)..(63): a, c, t, g, unknown or other
  modified_base (69)..(69): a, c, t, g, unknown or other
  modified_base (72)..(72): a, c, t, g, unknown or other
  modified_base (78)..(78): a, c, t, g, unknown or other
  modified_base (84)..(84): a, c, t, g, unknown or other
  modified_base (87)..(87): a, c, t, g, unknown or other
  modified_base (90)..(90): a, c, t, g, unknown or other
  modified_base (102)..(102): a, c, t, g, unknown or other
  modified_base (114)..(114): a, c, t, g, unknown or other
  modified_base (120)..(120): a, c, t, g, unknown or other
  modified_base (123)..(123): a, c, t, g, unknown or other
  modified_base (129)..(129): a, c, t, g, unknown or other
  modified_base (132)..(132): a, c, t, g, unknown or other
  modified_base (135)..(135): a, c, t, g, unknown or other
  modified_base (138)..(138): a, c, t, g, unknown or other
  modified_base (141)..(141): a, c, t, g, unknown or other
  modified_base (147)..(147): a, c, t, g, unknown or other
  modified_base (150)..(150): a, c, t, g, unknown or other
  modified_base (153)..(153): a, c, t, g, unknown or other
  modified_base (156)..(156): a, c, t, g, unknown or other
  modified_base (159)..(159): a, c, t, g, unknown or other
  modified_base (162)..(162): a, c, t, g, unknown or other
  modified_base (174)..(174): a, c, t, g, unknown or other
  modified_base (183)..(183): a, c, t, g, unknown or other
  modified_base (189)..(189): a, c, t, g, unknown or other
  modified_base (195)..(195): a, c, t, g, unknown or other
  modified_base (198)..(198): a, c, t, g, unknown or other
  modified_base (201)..(201): a, c, t, g, unknown or other
  modified_base (204)..(204): a, c, t, g, unknown or other
  modified_base (207)..(207): a, c, t, g, unknown or other
  modified_base (210)..(210): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (225)..(225): a, c, t, g, unknown or other
  modified_base (228)..(228): a, c, t, g, unknown or other
  modified_base (234)..(234): a, c, t, g, unknown or other
  modified_base (240)..(240): a, c, t, g, unknown or other
  modified_base (249)..(249): a, c, t, g, unknown or other
  modified_base (258)..(258): a, c, t, g, unknown or other
  modified_base (261)..(261): a, c, t, g, unknown or other
  modified_base (264)..(264): a, c, t, g, unknown or other
  modified_base (267)..(267): a, c, t, g, unknown or other
  modified_base (270)..(270): a, c, t, g, unknown or other
  modified_base (273)..(273): a, c, t, g, unknown or other
  modified_base (276)..(276): a, c, t, g, unknown or other
  modified_base (279)..(279): a, c, t, g, unknown or other
  modified_base (282)..(282): a, c, t, g, unknown or other
  modified_base (285)..(285): a, c, t, g, unknown or other
  modified_base (291)..(291): a, c, t, g, unknown or other
  modified_base (297)..(297): a, c, t, g, unknown or other
  modified_base (303)..(303): a, c, t, g, unknown or other
  modified_base (306)..(306): a, c, t, g, unknown or other
  modified_base (312)..(312): a, c, t, g, unknown or other
  modified_base (315)..(315): a, c, t, g, unknown or other
  modified_base (318)..(318): a, c, t, g, unknown or other
  modified_base (330)..(330): a, c, t, g, unknown or other
  modified_base (333)..(333): a, c, t, g, unknown or other
  modified_base (336)..(336): a, c, t, g, unknown or other
  modified_base (339)..(339): a, c, t, g, unknown or other
  modified_base (345)..(345): a, c, t, g, unknown or other
  modified_base (351)..(351): a, c, t, g, unknown or other
  modified_base (354)..(354): a, c, t, g, unknown or other
  modified_base (357)..(357): a, c, t, g, unknown or other
  modified_base (360)..(360): a, c, t, g, unknown or other
  modified_base (363)..(363): a, c, t, g, unknown or other
  modified_base (369)..(369): a, c, t, g, unknown or other
  modified_base (372)..(372): a, c, t, g, unknown or other
  modified_base (375)..(375): a, c, t, g, unknown or other
  modified_base (378)..(378): a, c, t, g, unknown or other
  modified_base (381)..(381): a, c, t, g, unknown or other
  modified_base (390)..(390): a, c, t, g, unknown or other
  modified_base (393)..(393): a, c, t, g, unknown or other
  modified_base (396)..(396): a, c, t, g, unknown or other
  modified_base (399)..(399): a, c, t, g, unknown or other
  modified_base (405)..(405): a, c, t, g, unknown or other
  modified_base (408)..(408): a, c, t, g, unknown or other
  modified_base (414)..(414): a, c, t, g, unknown or other
  modified_base (417)..(417): a, c, t, g, unknown or other
  modified_base (420)..(420): a, c, t, g, unknown or other
  modified_base (426)..(426): a, c, t, g, unknown or other
  modified_base (435)..(435): a, c, t, g, unknown or other
  modified_base (438)..(438): a, c, t, g, unknown or other
  modified_base (441)..(441): a, c, t, g, unknown or other
  modified_base (444)..(444): a, c, t, g, unknown or other
  modified_base (453)..(453): a, c, t, g, unknown or other
  modified_base (456)..(456): a, c, t, g, unknown or other
  modified_base (462)..(462): a, c, t, g, unknown or other
  modified_base (465)..(465): a, c, t, g, unknown or other
  modified_base (471)..(471): a, c, t, g, unknown or other
  modified_base (474)..(474): a, c, t, g, unknown or other
  modified_base (480)..(480): a, c, t, g, unknown or other
  modified_base (483)..(483): a, c, t, g, unknown or other
  modified_base (486)..(486): a, c, t, g, unknown or other
  modified_base (489)..(489): a, c, t, g, unknown or other
  modified_base (492)..(492): a, c, t, g, unknown or other
  modified_base (504)..(504): a, c, t, g, unknown or other
  modified_base (507)..(507): a, c, t, g, unknown or other
  modified_base (513)..(513): a, c, t, g, unknown or other
  modified_base (516)..(516): a, c, t, g, unknown or other
  modified_base (519)..(519): a, c, t, g, unknown or other
  modified_base (525)..(525): a, c, t, g, unknown or other
  modified_base (531)..(531): a, c, t, g, unknown or other
  modified_base (537)..(537): a, c, t, g, unknown or other
  modified_base (546)..(546): a, c, t, g, unknown or other
  modified_base (549)..(549): a, c, t, g, unknown or other
  modified_base (555)..(555): a, c, t, g, unknown or other
  modified_base (561)..(561): a, c, t, g, unknown or other
  modified_base (564)..(564): a, c, t, g, unknown or other
  modified_base (573)..(573): a, c, t, g, unknown or other
  modified_base (576)..(576): a, c, t, g, unknown or other
  modified_base (582)..(582): a, c, t, g, unknown or other
  modified_base (588)..(588): a, c, t, g, unknown or other
  modified_base (591)..(591): a, c, t, g, unknown or other
  modified_base (597)..(597): a, c, t, g, unknown or other
  modified_base (603)..(603): a, c, t, g, unknown or other
  modified_base (609)..(609): a, c, t, g, unknown or other
  modified_base (612)..(612): a, c, t, g, unknown or other
  modified_base (615)..(615): a, c, t, g, unknown or other
  modified_base (618)..(618): a, c, t, g, unknown or other
  modified_base (621)..(621): a, c, t, g, unknown or other
  modified_base (624)..(624): a, c, t, g, unknown or other
  modified_base (627)..(627): a, c, t, g, unknown or other
  modified_base (636)..(636): a, c, t, g, unknown or other
  modified_base (642)..(642): a, c, t, g, unknown or other
  modified_base (651)..(651): a, c, t, g, unknown or other
  modified_base (654)..(654): a, c, t, g, unknown or other
  modified_base (666)..(666): a, c, t, g, unknown or other
  modified_base (669)..(669): a, c, t, g, unknown or other
  modified_base (675)..(675): a, c, t, g, unknown or other
  modified_base (678)..(678): a, c, t, g, unknown or other
  modified_base (681)..(681): a, c, t, g, unknown or other
  modified_base (684)..(684): a, c, t, g, unknown or other
  modified_base (690)..(690): a, c, t, g, unknown or other
  modified_base (696)..(696): a, c, t, g, unknown or other
  modified_base (711)..(711): a, c, t, g, unknown or other
  modified_base (717)..(717): a, c, t, g, unknown or other
  modified_base (720)..(720): a, c, t, g, unknown or other
  modified_base (723)..(723): a, c, t, g, unknown or other
  modified_base (726)..(726): a, c, t, g, unknown or other
  modified_base (732)..(732): a, c, t, g, unknown or other
  modified_base (738)..(738): a, c, t, g, unknown or other
  modified_base (741)..(741): a, c, t, g, unknown or other
  modified_base (744)..(744): a, c, t, g, unknown or other
  modified_base (747)..(747): a, c, t, g, unknown or other
  modified_base (750)..(750): a, c, t, g, unknown or other
  modified_base (753)..(753): a, c, t, g, unknown or other
  modified_base (759)..(759): a, c, t, g, unknown or other
  modified_base (762)..(762): a, c, t, g, unknown or other
  modified_base (765)..(765): a, c, t, g, unknown or other
  modified_base (768)..(768): a, c, t, g, unknown or other
  modified_base (771)..(771): a, c, t, g, unknown or other
  modified_base (774)..(774): a, c, t, g, unknown or other
  modified_base (777)..(777): a, c, t, g, unknown or other
  modified_base (780)..(780): a, c, t, g, unknown or other
  modified_base (789)..(789): a, c, t, g, unknown or other
  modified_base (792)..(792): a, c, t, g, unknown or other
  modified_base (795)..(795): a, c, t, g, unknown or other
  modified_base (798)..(798): a, c, t, g, unknown or other
  modified_base (801)..(801): a, c, t, g, unknown or other
  modified_base (804)..(804): a, c, t, g, unknown or other
  modified_base (807)..(807): a, c, t, g, unknown or other
  modified_base (810)..(810): a, c, t, g, unknown or other
  modified_base (813)..(813): a, c, t, g, unknown or other
  modified_base (819)..(819): a, c, t, g, unknown or other
  modified_base (822)..(822): a, c, t, g, unknown or other
  modified_base (825)..(825): a, c, t, g, unknown or other
  modified_base (831)..(831): a, c, t, g, unknown or other
  modified_base (837)..(837): a, c, t, g, unknown or other
  modified_base (840)..(840): a, c, t, g, unknown or other
  modified_base (846)..(846): a, c, t, g, unknown or other
  modified_base (852)..(852): a, c, t, g, unknown or other
  modified_base (855)..(855): a, c, t, g, unknown or other
  modified_base (858)..(858): a, c, t, g, unknown or other
  modified_base (861)..(861): a, c, t, g, unknown or other
  modified_base (864)..(864): a, c, t, g, unknown or other
  modified_base (867)..(867): a, c, t, g, unknown or other
  modified_base (873)..(873): a, c, t, g, unknown or other
  modified_base (879)..(879): a, c, t, g, unknown or other
  modified_base (882)..(882): a, c, t, g, unknown or other
  modified_base (885)..(885): a, c, t, g, unknown or other
  modified_base (897)..(897): a, c, t, g, unknown or other
  modified_base (900)..(900): a, c, t, g, unknown or other
  modified_base (903)..(903): a, c, t, g, unknown or other
  modified_base (906)..(906): a, c, t, g, unknown or other
  modified_base (909)..(909): a, c, t, g, unknown or other
  modified_base (912)..(912): a, c, t, g, unknown or other
  modified_base (918)..(918): a, c, t, g, unknown or other
  modified_base (921)..(921): a, c, t, g, unknown or other
  modified_base (927)..(927): a, c, t, g, unknown or other
  modified_base (930)..(930): a, c, t, g, unknown or other
  modified_base (933)..(933): a, c, t, g, unknown or other
  modified_base (939)..(939): a, c, t, g, unknown or other
  modified_base (942)..(942): a, c, t, g, unknown or other
  modified_base (945)..(945): a, c, t, g, unknown or other
  modified_base (948)..(948): a, c, t, g, unknown or other
  modified_base (954)..(954): a, c, t, g, unknown or other
  modified_base (957)..(957): a, c, t, g, unknown or other
  modified_base (960)..(960): a, c, t, g, unknown or other
  modified_base (966)..(966): a, c, t, g, unknown or other
  modified_base (969)..(969): a, c, t, g, unknown or other
  modified_base (975)..(975): a, c, t, g, unknown or other
  modified_base (978)..(978): a, c, t, g, unknown or other
  modified_base (984)..(984): a, c, t, g, unknown or other
  modified_base (987)..(987): a, c, t, g, unknown or other
  modified_base (990)..(990): a, c, t, g, unknown or other
  modified_base (996)..(996): a, c, t, g, unknown or other
  modified_base (1002)..(1002): a, c, t, g, unknown or other
  modified_base (1005)..(1005): a, c, t, g, unknown or other
  modified_base (1008)..(1008): a, c, t, g, unknown or other
  modified_base (1014)..(1014): a, c, t, g, unknown or other
  modified_base (1029)..(1029): a, c, t, g, unknown or other
  modified_base (1035)..(1035): a, c, t, g, unknown or other
  modified_base (1038)..(1038): a, c, t, g, unknown or other
  modified_base (1041)..(1041): a, c, t, g, unknown or other
  modified_base (1044)..(1044): a, c, t, g, unknown or other
  modified_base (1053)..(1053): a, c, t, g, unknown or other
  modified_base (1056)..(1056): a, c, t, g, unknown or other
  modified_base (1062)..(1062): a, c, t, g, unknown or other
  modified_base (1065)..(1065): a, c, t, g, unknown or other
  modified_base (1071)..(1071): a, c, t, g, unknown or other
  modified_base (1074)..(1074): a, c, t, g, unknown or other
  modified_base (1086)..(1086): a, c, t, g, unknown or other
ccngarggnggnwsnytngcngcnytnacngcncaycargcntgycayytnccnytngaracnttyacnmgncaymgncarccnmgnggntgggarcarytngarcartgyggntayccngtncarmgnytngtngcnytntayytngcngcnmgnytnwsntggaaycargtngaycargtnathmgnaaygcnytngcnwsnccnggnwsnggnggngayytnggngargcnathmgngarcarccngarcargcnmgnytngcnytnacnytngcngcngcngarwsngarmgnttygtnmgncarggnacnggnaaygaygargcnggngcngcnaaygcngaygtngtnwsnytnacntgyccngtngcngcnggngartgygcnggnccngcngaywsnggngaygcnytnytngarmgnaaytayccnacnggngcngarttyytnggngayggnggngaygtnwsnttywsnacnmgnggnacncaraaytggacngtngarmgnytnytncargcncaymgncarytngargarmgnggntaygtnttygtnggntaycayggnacnttyytngargcngcncarwsnathgtnttyggnggngtnmgngcnmgnwsncargayytngaygcnathtggmgnggnttytayathgcnggngayccngcnytngcntayggntaygcncargaycargarccngaygcnmgnggnmgnathmgnaayggngcnytnytnmgngtntaygtnccnmgnwsnwsnytnccnggnttytaymgnacnwsnytnacnytngcngcnccngargcngcnggngargtngarmgnytnathggncayccnytnccnytnmgnytngaygcnathacnggnccngargargarggnggngcnytngcnacnathytnggntggccnytngcngarmgnacngtngtnathccnwsngcnathccnacngayccnmgnaaygtnggnggngayytngayccnwsnwsnathccngayaargarcargcnathwsngcnytnccngaytaygcnwsncarccnggnaarccnccnaargaygarytn

SEQ ID NO: 57 - DNA, 774 bp, Artificial Sequence
  source: /note="Description of Artificial Sequence: Synthetic polynucleotide"
  source: /note="gelonin ribotoxic region polynucleotide"
  modified_base (3)..(3): a, c, t, g, unknown or other
  modified_base (6)..(6): a, c, t, g, unknown or other
  modified_base (12)..(12): a, c, t, g, unknown or other
  modified_base (15)..(15): a, c, t, g, unknown or other
  modified_base (18)..(18): a, c, t, g, unknown or other
  modified_base (24)..(24): a, c, t, g, unknown or other
  modified_base (27)..(27): a, c, t, g, unknown or other
  modified_base (33)..(33): a, c, t, g, unknown or other
  modified_base (36)..(36): a, c, t, g, unknown or other
  modified_base (39)..(39): a, c, t, g, unknown or other
  modified_base (48)..(48): a, c, t, g, unknown or other
  modified_base (54)..(54): a, c, t, g, unknown or other
  modified_base (63)..(63): a, c, t, g, unknown or other
  modified_base (72)..(72): a, c, t, g, unknown or other
  modified_base (75)..(75): a, c, t, g, unknown or other
  modified_base (78)..(78): a, c, t, g, unknown or other
  modified_base (84)..(84): a, c, t, g, unknown or other
  modified_base (90)..(90): a, c, t, g, unknown or other
  modified_base (96)..(96): a, c, t, g, unknown or other
  modified_base (102)..(102): a, c, t, g, unknown or other
  modified_base (108)..(108): a, c, t, g, unknown or other
  modified_base (114)..(114): a, c, t, g, unknown or other
  modified_base (117)..(117): a, c, t, g, unknown or other
  modified_base (120)..(120): a, c, t, g, unknown or other
  modified_base (123)..(123): a, c, t, g, unknown or other
  modified_base (129)..(129): a, c, t, g, unknown or other
  modified_base (138)..(138): a, c, t, g, unknown or other
  modified_base (141)..(141): a, c, t, g, unknown or other
  modified_base (153)..(153): a, c, t, g, unknown or other
  modified_base (156)..(156): a, c, t, g, unknown or other
  modified_base (159)..(159): a, c, t, g, unknown or other
  modified_base (162)..(162): a, c, t, g, unknown or other
  modified_base (165)..(165): a, c, t, g, unknown or other
  modified_base (168)..(168): a, c, t, g, unknown or other
  modified_base (180)..(180): a, c, t, g, unknown or other
  modified_base (186)..(186): a, c, t, g, unknown or other
  modified_base (189)..(189): a, c, t, g, unknown or other
  modified_base (198)..(198): a, c, t, g, unknown or other
  modified_base (207)..(207): a, c, t, g, unknown or other
  modified_base (210)..(210): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (222)..(222): a, c, t, g, unknown or other
  modified_base (225)..(225): a, c, t, g, unknown or other
  modified_base (228)..(228): a, c, t, g, unknown or other
  modified_base (237)..(237): a, c, t, g, unknown or other
  modified_base (240)..(240): a, c, t, g, unknown or other
  modified_base (246)..(246): a, c, t, g, unknown or other
  modified_base (249)..(249): a, c, t, g, unknown or other
  modified_base (267)..(267): a, c, t, g, unknown or other
  modified_base (270)..(270): a, c, t, g, unknown or other
  modified_base (276)..(276): a, c, t, g, unknown or other
  modified_base (279)..(279): a, c, t, g, unknown or other
  modified_base (288)..(288): a, c, t, g, unknown or other
  modified_base (291)..(291): a, c, t, g, unknown or other
  modified_base (303)..(303): a, c, t, g, unknown or other
  modified_base (315)..(315): a, c, t, g, unknown or other
  modified_base (318)..(318): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (336)..(336): a, c, t, g, unknown or other
  modified_base (339)..(339): a, c, t, g, unknown or other
  modified_base (342)..(342): a, c, t, g, unknown or other
  modified_base (351)..(351): a, c, t, g, unknown or other
  modified_base (354)..(354): a, c, t, g, unknown or other
  modified_base (357)..(357): a, c, t, g, unknown or other
  modified_base (363)..(363): a, c, t, g, unknown or other
  modified_base (366)..(366): a, c, t, g, unknown or other
  modified_base (369)..(369): a, c, t, g, unknown or other
  modified_base (375)..(375): a, c, t, g, unknown or other
  modified_base (384)..(384): a, c, t, g, unknown or other
  modified_base (390)..(390): a, c, t, g, unknown or other
  modified_base (396)..(396): a, c, t, g, unknown or other
  modified_base (399)..(399): a, c, t, g, unknown or other
  modified_base (405)..(405): a, c, t, g, unknown or other
  modified_base (408)..(408): a, c, t, g, unknown or other
  modified_base (417)..(417): a, c, t, g, unknown or other
  modified_base (420)..(420): a, c, t, g, unknown or other
  modified_base (423)..(423): a, c, t, g, unknown or other
  modified_base (429)..(429): a, c, t, g, unknown or other
  modified_base (441)..(441): a, c, t, g, unknown or other
  modified_base (453)..(453): a, c, t, g, unknown or other
  modified_base (471)..(471): a, c, t, g, unknown or other
  modified_base (474)..(474): a, c, t, g, unknown or other
  modified_base (483)..(483): a, c, t, g, unknown or other
  modified_base (486)..(486): a, c, t, g, unknown or other
  modified_base (489)..(489): a, c, t, g, unknown or other
  modified_base (492)..(492): a, c, t, g, unknown or other
  modified_base (495)..(495): a, c, t, g, unknown or other
  modified_base (498)..(498): a, c, t, g, unknown or other
  modified_base (501)..(501): a, c, t, g, unknown or other
  modified_base (513)..(513): a, c, t, g, unknown or other
  modified_base (516)..(516): a, c, t, g, unknown or other
  modified_base (519)..(519): a, c, t, g, unknown or other
  modified_base (522)..(522): a, c, t, g, unknown or other
  modified_base (525)..(525): a, c, t, g, unknown or other
  modified_base (528)..(528): a, c, t, g, unknown or other
  modified_base (534)..(534): a, c, t, g, unknown or other
  modified_base (555)..(555): a, c, t, g, unknown or other
  modified_base (573)..(573): a, c, t, g, unknown or other
  modified_base (579)..(579): a, c, t, g, unknown or other
  modified_base (582)..(582): a, c, t, g, unknown or other
  modified_base (585)..(585): a, c, t, g, unknown or other
  modified_base (594)..(594): a, c, t, g, unknown or other
  modified_base (600)..(600): a, c, t, g, unknown or other
  modified_base (603)..(603): a, c, t, g, unknown or other
  modified_base (618)..(618): a, c, t, g, unknown or other
  modified_base (624)..(624): a, c, t, g, unknown or other
  modified_base (627)..(627): a, c, t, g, unknown or other
  modified_base (639)..(639): a, c, t, g, unknown or other
  modified_base (642)..(642): a, c, t, g, unknown or other
  modified_base (645)..(645): a, c, t, g, unknown or other
  modified_base (648)..(648): a, c, t, g, unknown or other
  modified_base (651)..(651): a, c, t, g, unknown or other
  modified_base (657)..(657): a, c, t, g, unknown or other
  modified_base (666)..(666): a, c, t, g, unknown or other
  modified_base (672)..(672): a, c, t, g, unknown or other
  modified_base (675)..(675): a, c, t, g, unknown or other
  modified_base (681)..(681): a, c, t, g, unknown or other
  modified_base (687)..(687): a, c, t, g, unknown or other
  modified_base (690)..(690): a, c, t, g, unknown or other
  modified_base (696)..(696): a, c, t, g, unknown or other
  modified_base (711)..(711): a, c, t, g, unknown or other
  modified_base (714)..(714): a, c, t, g, unknown or other
  modified_base (717)..(717): a, c, t, g, unknown or other
  modified_base (720)..(720): a, c, t, g, unknown or other
  modified_base (729)..(729): a, c, t, g, unknown or other
  modified_base (735)..(735): a, c, t, g, unknown or other
  modified_base (744)..(744): a, c, t, g, unknown or other
  modified_base (747)..(747): a, c, t, g, unknown or other
  modified_base (750)..(750): a, c, t, g, unknown or other
  modified_base (759)..(759): a, c, t, g, unknown or other
  modified_base (771)..(771): a, c, t, g, unknown or other
ggnytngayacngtnwsnttywsnacnaarggngcnacntayathacntaygtnaayttyytnaaygarytnmgngtnaarytnaarccngarggnaaywsncayggnathccnytnytnmgnaarggngaygayccnggnaartgyttygtnytngtngcnytnwsnaaygayaayggncarytngcngarathgcnathgaygtnacnwsngtngcngtngtnggntaycargtnmgnaaymgnwsntayttyttyaargaygcnccngaygcngcntaygarggnytnttyaaraayacnathaaraayccnytnytnttyggnggnaaracnmgnytncayttyggnggnwsntayccnwsnytngarggngaraargcntaymgngaracnacngayytnggnathgarccnytnmgnathggnathaaraarytngaygaraaygcnathgayaaytayaarccnacngarathgcnwsnwsnytnytngtngtnathcaratggtnwsngcngcngcnmgnttyacnttyathgaraaycarathmgnaayaayttycarcarmgnathmgnccngcnaayaayacnathwsnytngaraayaartggggnaarytnwsnttycarathmgnacnwsnggngcnaayggnatgttywsngargcngtngarytngarmgngcnaayggnaaraartaytaygtnacngcngtngaycargtnaarccnaarathgcnytnytnaarttygtngayaargayccngar

SEQ ID NO: 58 - DNA, 639 bp, Artificial Sequence
  source: /note="Description of Artificial Sequence: Synthetic polynucleotide"
  source: /note="saporin ribotoxic region polynucleotide variant 1"
  modified_base (3)..(3): a, c, t, g, unknown or other
  modified_base (9)..(9): a, c, t, g, unknown or other
  modified_base (12)..(12): a, c, t, g, unknown or other
  modified_base (18)..(18): a, c, t, g, unknown or other
  modified_base (21)..(21): a, c, t, g, unknown or other
  modified_base (27)..(27): a, c, t, g, unknown or other
  modified_base (30)..(30): a, c, t, g, unknown or other
  modified_base (33)..(33): a, c, t, g, unknown or other
  modified_base (36)..(36): a, c, t, g, unknown or other
  modified_base (45)..(45): a, c, t, g, unknown or other
  modified_base (48)..(48): a, c, t, g, unknown or other
  modified_base (54)..(54): a, c, t, g, unknown or other
  modified_base (66)..(66): a, c, t, g, unknown or other
  modified_base (75)..(75): a, c, t, g, unknown or other
  modified_base (84)..(84): a, c, t, g, unknown or other
  modified_base (90)..(90): a, c, t, g, unknown or other
  modified_base (99)..(99): a, c, t, g, unknown or other
  modified_base (102)..(102): a, c, t, g, unknown or other
  modified_base (105)..(105): a, c, t, g, unknown or other
  modified_base (114)..(114): a, c, t, g, unknown or other
  modified_base (117)..(117): a, c, t, g, unknown or other
  modified_base (123)..(123): a, c, t, g, unknown or other
  modified_base (126)..(126): a, c, t, g, unknown or other
  modified_base (129)..(129): a, c, t, g, unknown or other
  modified_base (132)..(132): a, c, t, g, unknown or other
  modified_base (147)..(147): a, c, t, g, unknown or other
  modified_base (150)..(150): a, c, t, g, unknown or other
  modified_base (165)..(165): a, c, t, g, unknown or other
  modified_base (168)..(168): a, c, t, g, unknown or other
  modified_base (171)..(171): a, c, t, g, unknown or other
  modified_base (174)..(174): a, c, t, g, unknown or other
  modified_base (177)..(177): a, c, t, g, unknown or other
  modified_base (180)..(180): a, c, t, g, unknown or other
  modified_base (183)..(183): a, c, t, g, unknown or other
  modified_base (186)..(186): a, c, t, g, unknown or other
  modified_base (189)..(189): a, c, t, g, unknown or other
  modified_base (192)..(192): a, c, t, g, unknown or other
  modified_base (198)..(198): a, c, t, g, unknown or other
  modified_base (207)..(207): a, c, t, g, unknown or other
  modified_base (210)..(210): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (225)..(225): a, c, t, g, unknown or other
  modified_base (228)..(228): a, c, t, g, unknown or other
  modified_base (240)..(240): a, c, t, g, unknown or other
  modified_base (246)..(246): a, c, t, g, unknown or other
  modified_base (252)..(252): a, c, t, g, unknown or other
  modified_base (255)..(255): a, c, t, g, unknown or other
  modified_base (267)..(267): a, c, t, g, unknown or other
  modified_base (270)..(270): a, c, t, g, unknown or other
  modified_base (279)..(279): a, c, t, g, unknown or other
  modified_base (282)..(282): a, c, t, g, unknown or other
  modified_base (285)..(285): a, c, t, g, unknown or other
  modified_base (291)..(291): a, c, t, g, unknown or other
  modified_base (294)..(294): a, c, t, g, unknown or other
  modified_base (297)..(297): a, c, t, g, unknown or other
  modified_base (300)..(300): a, c, t, g, unknown or other
  modified_base (306)..(306): a, c, t, g, unknown or other
  modified_base (312)..(312): a, c, t, g, unknown or other
  modified_base (315)..(315): a, c, t, g, unknown or other
  modified_base (318)..(318): a, c, t, g, unknown or other
  modified_base (321)..(321): a, c, t, g, unknown or other
  modified_base (333)..(333): a, c, t, g, unknown or other
  modified_base (336)..(336): a, c, t, g, unknown or other
  modified_base (345)..(345): a, c, t, g, unknown or other
  modified_base (360)..(360): a, c, t, g, unknown or other
  modified_base (375)..(375): a, c, t, g, unknown or other
  modified_base (384)..(384): a, c, t, g, unknown or other
  modified_base (390)..(390): a, c, t, g, unknown or other
  modified_base (399)..(399): a, c, t, g, unknown or other
  modified_base (402)..(402): a, c, t, g, unknown or other
  modified_base (411)..(411): a, c, t, g, unknown or other
  modified_base (414)..(414): a, c, t, g, unknown or other
  modified_base (417)..(417): a, c, t, g, unknown or other
  modified_base (420)..(420): a, c, t, g, unknown or other
  modified_base (429)..(429): a, c, t, g, unknown or other
  modified_base (432)..(432): a, c, t, g, unknown or other
  modified_base (435)..(435): a, c, t, g, unknown or other
  modified_base (438)..(438): a, c, t, g, unknown or other
  modified_base (450)..(450): a, c, t, g, unknown or other
  modified_base (453)..(453): a, c, t, g, unknown or other
  modified_base (465)..(465): a, c, t, g, unknown or other
  modified_base (468)..(468): a, c, t, g, unknown or other
  modified_base (471)..(471): a, c, t, g, unknown or other
  modified_base (474)..(474): a, c, t, g, unknown or other
  modified_base (486)..(486): a, c, t, g, unknown or other
  modified_base (489)..(489): a, c, t, g, unknown or other
  modified_base (495)..(495): a, c, t, g, unknown or other
  modified_base (498)..(498): a, c, t, g, unknown or other
  modified_base (504)..(504): a, c, t, g, unknown or other
  modified_base (516)..(516): a, c, t, g, unknown or other
  modified_base (519)..(519): a, c, t, g, unknown or other
  modified_base (525)..(525): a, c, t, g, unknown or other
  modified_base (528)..(528): a, c, t, g, unknown or other
  modified_base (531)..(531): a, c, t, g, unknown or other
  modified_base (537)..(537): a, c, t, g, unknown or other
  modified_base (552)..(552): a, c, t, g, unknown or other
  modified_base (555)..(555): a, c, t, g, unknown or other
  modified_base (558)..(558): a, c, t, g, unknown or other
  modified_base (570)..(570): a, c, t, g, unknown or other
  modified_base (585)..(585): a, c, t, g, unknown or other
  modified_base (597)..(597): a, c, t, g, unknown or other
  modified_base (612)..(612): a, c, t, g, unknown or other
  modified_base (615)..(615): a, c, t, g, unknown or other
  modified_base (621)..(621): a, c, t, g, unknown or other
  modified_base (630)..(630): a, c, t, g, unknown or other
  modified_base (633)..(633): a, c, t, g, unknown or other
  modified_base (636)..(636): a, c, t, g, unknown or other
wsnathacnytngayytngtnaayccnacngcnggncartaywsnwsnttygtngayaarathmgnaayaaygtnaargayccnaayytnaartayggnggnacngayathgcngtnathggnccnccnwsnaargaraarttyytnmgnathaayttycarwsnwsnmgnggnacngtnwsnytnggnytnaarmgngayaayytnwsngtngtngcntayytngcnatggayaayacnaaygtnaaymgngcntaytayttymgnwsngarathacnwsngcngarytnacngcnytnttyccngargcnacnacngcnaaycaraargcnytngartayacngargaytaycarwsnathgaraaraaygcncarathacncarggngayaarwsnmgnaargarytnggnytnggnathgayytnytnytnacnttyatggargcngtnaayaaraargcnmgngtngtnaaraaygargcnmgnttyytnytnathgcnathcaratgacngcngaygtngcnmgnttymgntayathcaraayytngtnacnaaraayttyccnaayaarttygaywsngayaayaargtnathcarttygargtnwsntggmgnaarathwsnacngcnath

SEQ ID NO: 59 - DNA, 873 bp, Artificial Sequence
  source: /note="Description of Artificial Sequence: Synthetic polynucleotide"
  source: /note="saporin ribotoxic region polynucleotide variant 2"
  modified_base (12)..(12): a, c, t, g, unknown or other
  modified_base (15)..(15): a, c, t, g, unknown or other
  modified_base (18)..(18): a, c, t, g, unknown or other
  modified_base (21)..(21): a, c, t, g, unknown or other
  modified_base (27)..(27): a, c, t, g, unknown or other
  modified_base (36)..(36): a, c, t, g, unknown or other
  modified_base (39)..(39): a, c, t, g, unknown or other
  modified_base (48)..(48): a, c, t, g, unknown or other
  modified_base (51)..(51): a, c, t, g, unknown or other
  modified_base (57)..(57): a, c, t, g, unknown or other
  modified_base (60)..(60): a, c, t, g, unknown or other
  modified_base (63)..(63): a, c, t, g, unknown or other
  modified_base (69)..(69): a, c, t, g, unknown or other
  modified_base (72)..(72): a, c, t, g, unknown or other
  modified_base (75)..(75): a, c, t, g, unknown or other
  modified_base (78)..(78): a, c, t, g, unknown or other
  modified_base (84)..(84): a, c, t, g, unknown or other
  modified_base (87)..(87): a, c, t, g, unknown or other
  modified_base (93)..(93): a, c, t, g, unknown or other
  modified_base (96)..(96): a, c, t, g, unknown or other
  modified_base (102)..(102): a, c, t, g, unknown or other
  modified_base (105)..(105): a, c, t, g, unknown or other
  modified_base (108)..(108): a, c, t, g, unknown or other
  modified_base (111)..(111): a, c, t, g, unknown or other
  modified_base (120)..(120): a, c, t, g, unknown or other
  modified_base (123)..(123): a, c, t, g, unknown or other
  modified_base (129)..(129): a, c, t, g, unknown or other
  modified_base (141)..(141): a, c, t, g, unknown or other
  modified_base (150)..(150): a, c, t, g, unknown or other
  modified_base (159)..(159): a, c, t, g, unknown or other
  modified_base (165)..(165): a, c, t, g, unknown or other
  modified_base (174)..(174): a, c, t, g, unknown or other
  modified_base (177)..(177): a, c, t, g, unknown or other
  modified_base (180)..(180): a, c, t, g, unknown or other
  modified_base (189)..(189): a, c, t, g, unknown or other
  modified_base (192)..(192): a, c, t, g, unknown or other
  modified_base (198)..(198): a, c, t, g, unknown or other
  modified_base (201)..(201): a, c, t, g, unknown or other
  modified_base (204)..(204): a, c, t, g, unknown or other
  modified_base (207)..(207): a, c, t, g, unknown or other
  modified_base (222)..(222): a, c, t, g, unknown or other
  modified_base (225)..(225): a, c, t, g, unknown or other
  modified_base (240)..(240): a, c, t, g, unknown or other
  modified_base (243)..(243): a, c, t, g, unknown or other
  modified_base (246)..(246): a, c, t, g, unknown or other
  modified_base (249)..(249): a, c, t, g, unknown or other
  modified_base (252)..(252): a, c, t, g, unknown or other
  modified_base (255)..(255): a, c, t, g, unknown or other
  modified_base (258)..(258): a, c, t, g, unknown or other
  modified_base (261)..(261): a, c, t, g, unknown or other
  modified_base (264)..(264): a, c, t, g, unknown or other
  modified_base (267)..(267): a, c, t, g, unknown or other
  modified_base (273)..(273): a, c, t, g, unknown or other
  modified_base (282)..(282): a, c, t, g, unknown or other
  modified_base (285)..(285): a, c, t, g, unknown or other
  modified_base (288)..(288): a, c, t, g, unknown or other
  modified_base (291)..(291): a, c, t, g, unknown or other
  modified_base (294)..(294): a, c, t, g, unknown or other
  modified_base (300)..(300): a, c, t, g, unknown or other
  modified_base (303)..(303): a, c, t, g, unknown or other
  modified_base (315)..(315): a, c, t, g, unknown or other
  modified_base (321)..(321): a, c, t, g, unknown or other
  modified_base (327)..(327): a, c, t, g, unknown or other
  modified_base (330)..(330): a, c, t, g, unknown or other
  modified_base (345)..(345): a, c, t, g, unknown or other
  modified_base (354)..(354): a, c, t, g, unknown or other
  modified_base (357)..(357): a, c, t, g, unknown or other
  modified_base (360)..(360): a, c, t, g, unknown or other
  modified_base (366)..(366): a, c, t, g, unknown or other
  modified_base (369)..(369): a, c, t, g, unknown or other
  modified_base (372)..(372): a, c, t, g, unknown or other
  modified_base (375)..(375): a, c, t, g, unknown or other
  modified_base (381)..(381): a, c, t, g, unknown or other
  modified_base (387)..(387): a, c, t, g, unknown or other
  modified_base (390)..(390): a, c, t, g, unknown or other
  modified_base (393)..(393): a, c, t, g, unknown or other
  modified_base (396)..(396): a, c, t, g, unknown or other
  modified_base (408)..(408): a, c, t, g, unknown or other
  modified_base (411)..(411): a, c, t, g, unknown or other
  modified_base (420)..(420): a, c, t, g, unknown or other
  modified_base (435)..(435): a, c, t, g, unknown or other
  modified_base (450)..(450): a, c, t, g, unknown or other
  modified_base (459)..(459): a, c, t, g, unknown or other
  modified_base (465)..(465): a, c, t, g, unknown or other
  modified_base (474)..(474): a, c, t, g, unknown or other
  modified_base (477)..(477): a, c, t, g, unknown or other
  modified_base (486)..(486): a, c, t, g, unknown or other
  modified_base (489)..(489): a, c, t, g, unknown or other
  modified_base (492)..(492): a, c, t, g, unknown or other
  modified_base (495)..(495): a, c, t, g, unknown or other
  modified_base (504)..(504): a, c, t, g, unknown or other
  modified_base (507)..(507): a, c, t, g, unknown or other
  modified_base (510)..(510): a, c, t, g, unknown or other
  modified_base (513)..(513): a, c, t, g, unknown or other
  modified_base (525)..(525): a, c, t, g, unknown or other
  modified_base (528)..(528): a, c, t, g, unknown or other
  modified_base (540)..(540): a, c, t, g, unknown or other
  modified_base (543)..(543): a, c, t, g, unknown or other
  modified_base (546)..(546): a, c, t, g, unknown or other
  modified_base (549)..(549): a, c, t, g, unknown or other
  modified_base (561)..(561): a, c, t, g, unknown or other
  modified_base (564)..(564): a, c, t, g, unknown or other
  modified_base (570)..(570): a, c, t, g, unknown or other
  modified_base (573)..(573): a, c, t, g, unknown or other
  modified_base (579)..(579): a, c, t, g, unknown or other
  modified_base (591)..(591): a, c, t, g, unknown or other
  modified_base (594)..(594): a, c, t, g, unknown or other
  modified_base (600)..(600): a, c, t, g, unknown or other
  modified_base (603)..(603): a, c, t, g, unknown or other
  modified_base (606)..(606): a, c, t, g, unknown or other
  modified_base (612)..(612): a, c, t, g, unknown or other
  modified_base (627)..(627): a, c, t, g, unknown or other
  modified_base (630)..(630): a, c, t, g, unknown or other
  modified_base (633)..(633): a, c, t, g, unknown or other
  modified_base (645)..(645): a, c, t, g, unknown or other
  modified_base (660)..(660): a, c, t, g, unknown or other
  modified_base (672)..(672): a, c, t, g, unknown or other
  modified_base (687)..(687): a, c, t, g, unknown or other
  modified_base (690)..(690): a, c, t, g, unknown or other
  modified_base (696)..(696): a, c, t, g, unknown or other
  modified_base (705)..(705): a, c, t, g, unknown or other
  modified_base (708)..(708): a, c, t, g, unknown or other
  modified_base (711)..(711): a, c, t, g, unknown or other
  modified_base (720)..(720): a, c, t, g, unknown or other
  modified_base (726)..(726): a, c, t, g, unknown or other
  modified_base (735)..(735): a, c, t, g, unknown or other
  modified_base (738)..(738): a, c, t, g, unknown or other
  modified_base (762)..(762): a, c, t, g, unknown or other
  modified_base (768)..(768): a, c, t, g, unknown or other
  modified_base (774)..(774): a, c, t, g, unknown or other
  modified_base (777)..(777): a, c, t, g, unknown or other
  modified_base (783)..(783): a, c, t, g, unknown or other
  modified_base (792)..(792): a, c, t, g, unknown or other
  modified_base (801)..(801): a, c, t, g, unknown or other
  modified_base (804)..(804): a, c, t, g, unknown or other
  modified_base (807)..(807): a, c, t, g, unknown or other
  modified_base (816)..(816): a, c, t, g, unknown or other
  modified_base (819)..(819): a, c, t, g, unknown or other
  modified_base (825)..(825): a, c, t, g, unknown or other
  modified_base (831)..(831): a, c, t, g, unknown or other
  modified_base (834)..(834): a, c, t, g, unknown or other
  modified_base (843)..(843): a, c, t, g, unknown or other
  modified_base (849)..(849): a, c, t, g, unknown or other
  modified_base (852)..(852): a, c, t, g, unknown or other
  modified_base (855)..(855): a, c, t, g, unknown or other
  modified_base (861)..(861): a, c, t, g, unknown or other
  modified_base (864)..(864): a, c, t, g, unknown or other
  modified_base (867)..(867): a, c, t, g, unknown or other
  modified_base (870)..(870): a, c, t, g, unknown or other
  modified_base (873)..(873): a, c, t, g, unknown or other
aarathtaygtngtngcnacnathgcntggathytnytncarttywsngcntggacnacnacngaygcngtnacnwsnathacnytngayytngtnaayccnacngcnggncartaywsnwsnttygtngayaarathmgnaayaaygtnaargayccnaayytnaartayggnggnacngayathgcngtnathggnccnccnwsnaargayaarttyytnmgnathaayttycarwsnwsnmgnggnacngtnwsnytnggnytnaarmgngayaayytngcngtngtngcntayytngcnatggayaayacnaaygtnaaymgngcntaytayttyaarwsngarathacnwsngcngarytnacngcnytnttyccngargcnacnacngcnaaycaraargcnytngartayacngargaytaycarwsnathgaraaraaygcncarathacncarggngayaarwsnmgnaargarytnggnytnggnathgayytnytnytnacnttyatggargcngtnaayaaraargcnmgngtngtnaaraaygargcnmgnttyytnytnathgcnathcaratgacngcngaygtngcnmgnttymgntayathcaraayytngtnacnaaraayttyccnaayaarttygaywsngayaayaargtnathcarttygargtnwsntggmgnaarathwsnacngcnathtayggngaygcnaaraayggngtnttyaayaargaytaygayttyggnttyggnaargtnmgncargtnaargayytncaratgggnytnytnatgtayytnggnaarccnaarwsnwsnaaygargcnaaywsnacngcntaygcnacnacngtnytn

SEQ ID NO: 60 - DNA, 759 bp, Artificial Sequence
  source: /note="Description of Artificial Sequence: Synthetic polynucleotide"
  source: /note="saporin ribotoxic region polynucleotide variant 3"
  modified_base (3)..(3): a, c, t, g, unknown or other
  modified_base (6)..(6): a, c, t, g, unknown or other
  modified_base (9)..(9): a, c, t, g, unknown or other
  modified_base (15)..(15): a, c, t, g, unknown or other
  modified_base (18)..(18): a, c, t, g, unknown or other
  modified_base (24)..(24): a, c, t, g, unknown or other
  modified_base (27)..(27): a, c, t, g, unknown or other
  modified_base (33)..(33): a, c, t, g, unknown or other
  modified_base (36)..(36): a, c, t, g, unknown or other
  modified_base (39)..(39): a, c, t, g, unknown or other
  modified_base (42)..(42): a, c, t, g, unknown or other
  modified_base (51)..(51): a, c, t, g, unknown or other
  modified_base (54)..(54): a, c, t, g, unknown or other
  modified_base (60)..(60): a, c, t, g, unknown or other
  modified_base (72)..(72): a, c, t, g, unknown or other
  modified_base (81)..(81): a, c, t, g, unknown or other
  modified_base (90)..(90): a, c, t, g, unknown or other
  modified_base (96)..(96): a, c, t, g, unknown or other
  modified_base (105)..(105): a, c, t, g, unknown or other
  modified_base (108)..(108): a, c, t, g, unknown or other
  modified_base (111)..(111): a, c, t, g, unknown or other
  modified_base (120)..(120): a, c, t, g, unknown or other
  modified_base (123)..(123): a, c, t, g, unknown or other
  modified_base (129)..(129): a, c, t, g, unknown or other
  modified_base (132)..(132): a, c, t, g, unknown or other
  modified_base (135)..(135): a, c, t, g, unknown or other
  modified_base (138)..(138): a, c, t, g, unknown or other
  modified_base (153)..(153): a, c, t, g, unknown or other
  modified_base (156)..(156): a, c, t, g, unknown or other
  modified_base (171)..(171): a, c, t, g, unknown or other
  modified_base (174)..(174): a, c, t, g, unknown or other
  modified_base (177)..(177): a, c, t, g, unknown or other
  modified_base (180)..(180): a, c, t, g, unknown or other
  modified_base (183)..(183): a, c, t, g, unknown or other
  modified_base (186)..(186): a, c, t, g, unknown or other
  modified_base (189)..(189): a, c, t, g, unknown or other
  modified_base (192)..(192): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (222)..(222): a, c, t, g, unknown or other
  modified_base (225)..(225): a, c, t, g, unknown or other
  modified_base (231)..(231): a, c, t, g, unknown or other
  modified_base (234)..(234): a, c, t, g, unknown or other
  modified_base (246)..(246): a, c, t, g, unknown or other
  modified_base (252)..(252): a, c, t, g, unknown or other
  modified_base (258)..(258): a, c, t, g, unknown or other
  modified_base (261)..(261): a, c, t, g, unknown or other
  modified_base (273)..(273): a, c, t, g, unknown or other
  modified_base (276)..(276): a, c, t, g, unknown or other
  modified_base (285)..(285): a, c, t, g, unknown or other
  modified_base (288)..(288): a, c, t, g, unknown or other
  modified_base (291)..(291): a, c, t, g, unknown or other
  modified_base (297)..(297): a, c, t, g, unknown or other
  modified_base (300)..(300): a, c, t, g, unknown or other
  modified_base (303)..(303): a, c, t, g, unknown or other
  modified_base (306)..(306): a, c, t, g, unknown or other
  modified_base (312)..(312): a, c, t, g, unknown or other
  modified_base (318)..(318): a, c, t, g, unknown or other
  modified_base (321)..(321): a, c, t, g, unknown or other
  modified_base (324)..(324): a, c, t, g, unknown or other
  modified_base (327)..(327): a, c, t, g, unknown or other
  modified_base (339)..(339): a, c, t, g, unknown or other
  modified_base (342)..(342): a, c, t, g, unknown or other
  modified_base (351)..(351): a, c, t, g, unknown or other
  modified_base (366)..(366): a, c, t, g, unknown or other
  modified_base (381)..(381): a, c, t, g, unknown or other
  modified_base (390)..(390): a, c, t, g, unknown or other
  modified_base (396)..(396): a, c, t, g, unknown or other
  modified_base (405)..(405): a, c, t, g, unknown or other
  modified_base (408)..(408): a, c, t, g, unknown or other
  modified_base (417)..(417): a, c, t, g, unknown or other
  modified_base (420)..(420): a, c, t, g, unknown or other
  modified_base (423)..(423): a, c, t, g, unknown or other
  modified_base (426)..(426): a, c, t, g, unknown or other
  modified_base (435)..(435): a, c, t, g, unknown or other
  modified_base (438)..(438): a, c, t, g, unknown or other
  modified_base (441)..(441): a, c, t, g, unknown or other
  modified_base (444)..(444): a, c, t, g, unknown or other
  modified_base (456)..(456): a, c, t, g, unknown or other
  modified_base (459)..(459): a, c, t, g, unknown or other
  modified_base (471)..(471): a, c, t, g, unknown or other
  modified_base (474)..(474): a, c, t, g, unknown or other
  modified_base (477)..(477): a, c, t, g, unknown or other
  modified_base (480)..(480): a, c, t, g, unknown or other
  modified_base (492)..(492): a, c, t, g, unknown or other
  modified_base (495)..(495): a, c, t, g, unknown or other
  modified_base (501)..(501): a, c, t, g, unknown or other
  modified_base (504)..(504): a, c, t, g, unknown or other
  modified_base (510)..(510): a, c, t, g, unknown or other
  modified_base (522)..(522): a, c, t, g, unknown or other
  modified_base (525)..(525): a, c, t, g, unknown or other
  modified_base (528)..(528): a, c, t, g, unknown or other
  modified_base (531)..(531): a, c, t, g, unknown or other
  modified_base (534)..(534): a, c, t, g, unknown or other
  modified_base (537)..(537): a, c, t, g, unknown or other
  modified_base (543)..(543): a, c, t, g, unknown or other
  modified_base (558)..(558): a, c, t, g, unknown or other
  modified_base (561)..(561): a, c, t, g, unknown or other
  modified_base (564)..(564): a, c, t, g, unknown or other
  modified_base (576)..(576): a, c, t, g, unknown or other
  modified_base (591)..(591): a, c, t, g, unknown or other
  modified_base (603)..(603): a, c, t, g, unknown or other
  modified_base (618)..(618): a, c, t, g, unknown or other
  modified_base (621)..(621): a, c, t, g, unknown or other
  modified_base (627)..(627): a, c, t, g, unknown or other
  modified_base (636)..(636): a, c, t, g, unknown or other
  modified_base (639)..(639): a, c, t, g, unknown or other
  modified_base (642)..(642): a, c, t, g, unknown or other
  modified_base (651)..(651): a, c, t, g, unknown or other
  modified_base (657)..(657): a, c, t, g, unknown or other
  modified_base (666)..(666): a, c, t, g, unknown or other
  modified_base (669)..(669): a, c, t, g, unknown or other
  modified_base (693)..(693): a, c, t, g, unknown or other
  modified_base (699)..(699): a, c, t, g, unknown or other
  modified_base (705)..(705): a, c, t, g, unknown or other
  modified_base (708)..(708): a, c, t, g, unknown or other
  modified_base (714)..(714): a, c, t, g, unknown or other
  modified_base (723)..(723): a, c, t, g, unknown or other
  modified_base (732)..(732): a, c, t, g, unknown or other
  modified_base (735)..(735): a, c, t, g, unknown or other
  modified_base (738)..(738): a, c, t, g, unknown or other
  modified_base (747)..(747): a, c, t, g, unknown or other
  modified_base (750)..(750): a, c, t, g, unknown or other
  modified_base (756)..(756): a, c, t, g, unknown or other
gtnacnwsnathacnytngayytngtnaayccnacngcnggncartaywsnwsnttygtngayaarathmgnaayaaygtnaargayccnaayytnaartayggnggnacngayathgcngtnathggnccnccnwsnaargaraarttyytnmgnathaayttycarwsnwsnmgnggnacngtnwsnytnggnytnaarmgngayaayytngcngtngtngcntayytngcnatggayaayacnaaygtnaaymgngcntaytayttymgnwsngarathacnwsngcngarytnacngcnytnttyccngargcnacnacngcnaaycaraargcnytngartayacngargaytaycarwsnathgaraaraaygcncarathacncarggngayaarwsnmgnaargarytnggnytnggnathgayytnytnytnacnttyatggargcngtnaayaaraargcnmgngtngtnaaraaygargcnmgnttyytnytnathgcnathcaratgacngcngcngtngcnmgnttymgntayathcaraayytngtnacnaaraayttyccnaayaarttygaywsngayaayaargtnathcarttygargtnwsntggmgnaarathwsnacngcnathtayggngaygcnaaraayggngtnttyaayaargaytaygayttyggnttyggnaargtnmgncargtnaargayytncaratgggnytnytnatgtayytnggnaarccnaar

SEQ ID NO: 61 - DNA, 741 bp, Artificial Sequence
  source: /note="Description of Artificial Sequence: Synthetic polynucleotide"
  source: /note="bryodin ribotoxic region polynucleotide"
  modified_base (6)..(6): a, c, t, g, unknown or other
  modified_base (9)..(9): a, c, t, g, unknown or other
  modified_base (15)..(15): a, c, t, g, unknown or other
  modified_base (18)..(18): a, c, t, g, unknown or other
  modified_base (21)..(21): a, c, t, g, unknown or other
  modified_base (24)..(24): a, c, t, g, unknown or other
  modified_base (27)..(27): a, c, t, g, unknown or other
  modified_base (30)..(30): a, c, t, g, unknown or other
  modified_base (33)..(33): a, c, t, g, unknown or other
  modified_base (36)..(36): a, c, t, g, unknown or other
  modified_base (39)..(39): a, c, t, g, unknown or other
  modified_base (45)..(45): a, c, t, g, unknown or other
  modified_base (48)..(48): a, c, t, g, unknown or other
  modified_base (63)..(63): a, c, t, g, unknown or other
  modified_base (66)..(66): a, c, t, g, unknown or other
  modified_base (72)..(72): a, c, t, g, unknown or other
  modified_base (75)..(75): a, c, t, g, unknown or other
  modified_base (78)..(78): a, c, t, g, unknown or other
  modified_base (87)..(87): a, c, t, g, unknown or other
  modified_base (93)..(93): a, c, t, g, unknown or other
  modified_base (105)..(105): a, c, t, g, unknown or other
  modified_base (108)..(108): a, c, t, g, unknown or other
  modified_base (111)..(111): a, c, t, g, unknown or other
  modified_base (114)..(114): a, c, t, g, unknown or other
  modified_base (117)..(117): a, c, t, g, unknown or other
  modified_base (120)..(120): a, c, t, g, unknown or other
  modified_base (126)..(126): a, c, t, g, unknown or other
  modified_base (129)..(129): a, c, t, g, unknown or other
  modified_base (132)..(132): a, c, t, g, unknown or other
  modified_base (135)..(135): a, c, t, g, unknown or other
  modified_base (138)..(138): a, c, t, g, unknown or other
  modified_base (144)..(144): a, c, t, g, unknown or other
  modified_base (147)..(147): a, c, t, g, unknown or other
  modified_base (150)..(150): a, c, t, g, unknown or other
  modified_base (156)..(156): a, c, t, g, unknown or other
  modified_base (159)..(159): a, c, t, g, unknown or other
  modified_base (168)..(168): a, c, t, g, unknown or other
  modified_base (177)..(177): a, c, t, g, unknown or other
  modified_base (183)..(183): a, c, t, g, unknown or other
  modified_base (186)..(186): a, c, t, g, unknown or other
  modified_base (189)..(189): a, c, t, g, unknown or other
  modified_base (192)..(192): a, c, t, g, unknown or other
  modified_base (198)..(198): a, c, t, g, unknown or other
  modified_base (201)..(201): a, c, t, g, unknown or other
  modified_base (207)..(207): a, c, t, g, unknown or other
  modified_base (210)..(210): a, c, t, g, unknown or other
  modified_base (219)..(219): a, c, t, g, unknown or other
  modified_base (225)..(225): a, c, t, g, unknown or other
  modified_base (228)..(228): a, c, t, g, unknown or other
  modified_base (231)..(231): a, c, t, g, unknown or other
  modified_base (237)..(237): a, c, t, g, unknown or other
  modified_base (240)..(240): a, c, t, g, unknown or other
  modified_base (258)..(258): a, c, t, g, unknown or other
  modified_base (261)..(261): a, c, t, g, unknown or other
  modified_base (264)..(264): a, c, t, g, unknown or other
  modified_base (267)..(267): a, c, t, g, unknown or other
  modified_base (273)..(273): a, c, t, g, unknown or other
  modified_base (276)..(276): a, c, t, g, unknown or other
  modified_base (285)..(285): a, c, t, g, unknown or other
  modified_base (297)..(297): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (318)..(318): a, c, t, g, unknown or other
  modified_base (324)..(324): a, c, t, g, unknown or other
  modified_base (327)..(327): a, c, t, g, unknown or other
  modified_base (339)..(339): a, c, t, g, unknown or other
  modified_base (342)..(342): a, c, t, g, unknown or other
  modified_base (348)..(348): a, c, t, g, unknown or other
  modified_base (351)..(351): a, c, t, g, unknown or other
  modified_base (354)..(354): a, c, t, g, unknown or other
  modified_base (357)..(357): a, c, t, g, unknown or other
  modified_base (366)..(366): a, c, t, g, unknown or other
  modified_base (378)..(378): a, c, t, g, unknown or other
  modified_base (381)..(381): a, c, t, g, unknown or other
  modified_base (384)..(384): a, c, t, g, unknown or other
  modified_base (387)..(387): a, c, t, g, unknown or other
  modified_base (390)..(390): a, c, t, g, unknown or other
  modified_base (393)..(393): a, c, t, g, unknown or other
  modified_base (396)..(396): a, c, t, g, unknown or other
  modified_base (402)..(402): a, c, t, g, unknown or other
  modified_base (405)..(405): a, c, t, g, unknown or other
  modified_base (411)..(411): a, c, t, g, unknown or other
  modified_base (414)..(414): a, c, t, g, unknown or other
  modified_base (417)..(417): a, c, t, g, unknown or other
  modified_base (429)..(429): a, c, t, g, unknown or other
  modified_base (432)..(432): a, c, t, g, unknown or other
  modified_base (435)..(435): a, c, t, g, unknown or other
  modified_base (438)..(438): a, c, t, g, unknown or other
  modified_base (441)..(441): a, c, t, g, unknown or other
  modified_base (444)..(444): a, c, t, g, unknown or other
  modified_base (447)..(447): a, c, t, g, unknown or other
  modified_base (450)..(450): a, c, t, g, unknown or other
  modified_base (453)..(453): a, c, t, g, unknown or other
  modified_base (456)..(456): a, c, t, g, unknown or other
  modified_base (459)..(459): a, c, t, g, unknown or other
  modified_base (462)..(462): a, c, t, g, unknown or other
  modified_base (471)..(471): a, c, t, g, unknown or other
  modified_base (474)..(474): a, c, t, g, unknown or other
  modified_base (477)..(477): a, c, t, g, unknown or other
  modified_base (480)..(480): a, c, t, g, unknown or other
  modified_base (483)..(483): a, c, t, g, unknown or other
  modified_base (486)..(486): a, c, t, g, unknown or other
  modified_base (489)..(489): a, c, t, g, unknown or other
  modified_base (516)..(516): a, c, t, g, unknown or other
  modified_base (522)..(522): a, c, t, g, unknown or other
  modified_base (525)..(525): a, c, t, g, unknown or other
  modified_base (534)..(534): a, c, t, g, unknown or other
  modified_base (540)..(540): a, c, t, g, unknown or other
  modified_base (543)..(543): a, c, t, g, unknown or other
  modified_base (546)..(546): a, c, t, g, unknown or other
  modified_base (549)..(549): a, c, t, g, unknown or other
  modified_base (552)..(552): a, c, t, g, unknown or other
  modified_base (555)..(555): a, c, t, g, unknown or other
  modified_base (561)..(561): a, c, t, g, unknown or other
  modified_base (564)..(564): a, c, t, g, unknown or other
  modified_base (579)..(579): a, c, t, g, unknown or other
  modified_base (582)..(582): a, c, t, g, unknown or other
  modified_base (585)..(585): a, c, t, g, unknown or other
  modified_base (588)..(588): a, c, t, g, unknown or other
  modified_base (606)..(606): a, c, t, g, unknown or other
  modified_base (609)..(609): a, c, t, g, unknown or other
  modified_base (612)..(612): a, c, t, g, unknown or other
  modified_base (621)..(621): a, c, t, g, unknown or other
  modified_base (633)..(633): a, c, t, g, unknown or other
  modified_base (636)..(636): a, c, t, g, unknown or other
  modified_base (639)..(639): a, c, t, g, unknown or other
  modified_base (642)..(642): a, c, t, g, unknown or other
  modified_base (645)..(645): a, c, t, g, unknown or other
  modified_base (654)..(654): a, c, t, g, unknown or other
  modified_base (666)..(666): a, c, t, g, unknown or other
  modified_base (669)..(669): a, c, t, g, unknown or other
  modified_base (672)..(672): a, c, t, g, unknown or other
  modified_base (678)..(678): a, c, t, g, unknown or other
  modified_base (684)..(684): a, c, t, g, unknown or other
  modified_base (687)..(687): a, c, t, g, unknown or other
  modified_base (690)..(690): a, c, t, g, unknown or other
  modified_base (693)..(693): a, c, t, g, unknown or other
  modified_base (696)..(696): a, c, t, g, unknown or other
  modified_base (699)..(699): a, c, t, g, unknown or other
  modified_base (702)..(702): a, c, t, g, unknown or other
  modified_base (705)..(705): a, c, t, g, unknown or other
  modified_base (714)..(714): a, c, t, g, unknown or other
  modified_base (717)..(717): a, c, t, g, unknown or other
  modified_base (720)..(720): a, c, t, g, unknown or other
  modified_base (723)..(723): a, c, t, g, unknown or other
  modified_base (729)..(729): a, c, t, g, unknown or other
  modified_base (741)..(741): a, c, t, g, unknown or other
gaygtnwsnttymgnytnwsnggngcnacnacnacnwsntayggngtnttyathaaraayytnmgngargcnytnccntaygarmgnaargtntayaayathccnytnytnmgnwsnwsnathwsnggnwsnggnmgntayacnytnytncayytnacnaaytaygcngaygaracnathwsngtngcngtngaygtnacnaaygtngcnathatgggntayytngcnggngaygtnwsntayttyttyaaygargcnwsngcnacngargcngcnaarttygtnttyaargaygcnaaraaraargtnacnytnccntaywsnggnaaytaygarmgnytncaracngcngcnggnaarathmgngaraayathccnytnggnytnccngcnytngaywsngcnathacnacnytntaytaytayacngcnwsnwsngcngcnwsngcnytnytngtnytnathcarwsnacngcngcnwsngcnmgntayaarttyathgarcarcarathggnaarmgngtngayaaracnttyytnccnwsnytngcnacnathwsnytngaraayaaytggwsngcnytnwsnaarcarathcarathgcnwsnacnaayaayggncarttygarwsnccngtngtnytnathgayggnaayaaycarmgngtnwsnathacnaaygcnwsngcnmgngtngtnacnwsnaayathgcnytnytnytnaaymgnaayaayathgcn

SEQ ID NO: 62 - DNA, 525 bp, Artificial Sequence
  source: /note="Description of Artificial Sequence: Synthetic polynucleotide"
  source: /note="Aspf1 ribotoxic region polynucleotide"
  modified_base (3)..(3): a, c, t, g, unknown or other
  modified_base (6)..(6): a, c, t, g, unknown or other
  modified_base (18)..(18): a, c, t, g, unknown or other
  modified_base (24)..(24): a, c, t, g, unknown or other
  modified_base (27)..(27): a, c, t, g, unknown or other
  modified_base (30)..(30): a, c, t, g, unknown or other
  modified_base (33)..(33): a, c, t, g, unknown or other
  modified_base (36)..(36): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (51)..(51): a, c, t, g, unknown or other
  modified_base (54)..(54): a, c, t, g, unknown or other
  modified_base (57)..(57): a, c, t, g, unknown or other
  modified_base (60)..(60): a, c, t, g, unknown or other
  modified_base (63)..(63): a, c, t, g, unknown or other
  modified_base (66)..(66): a, c, t, g, unknown or other
  modified_base (69)..(69): a, c, t, g, unknown or other
  modified_base (75)..(75): a, c, t, g, unknown or other
  modified_base (78)..(78): a, c, t, g, unknown or other
  modified_base (81)..(81): a, c, t, g, unknown or other
  modified_base (84)..(84): a, c, t, g, unknown or other
  modified_base (90)..(90): a, c, t, g, unknown or other
  modified_base (108)..(108): a, c, t, g, unknown or other
  modified_base (114)..(114): a, c, t, g, unknown or other
  modified_base (120)..(120): a, c, t, g, unknown or other
  modified_base (141)..(141): a, c, t, g, unknown or other
  modified_base (144)..(144): a, c, t, g, unknown or other
  modified_base (147)..(147): a, c, t, g, unknown or other
  modified_base (153)..(153): a, c, t, g, unknown or other
  modified_base (159)..(159): a, c, t, g, unknown or other
  modified_base (165)..(165): a, c, t, g, unknown or other
  modified_base (171)..(171): a, c, t, g, unknown or other
  modified_base (177)..(177): a, c, t, g, unknown or other
  modified_base (186)..(186): a, c, t, g, unknown or other
  modified_base (189)..(189): a, c, t, g, unknown or other
  modified_base (192)..(192): a, c, t, g, unknown or other
  modified_base (195)..(195): a, c, t, g, unknown or other
  modified_base (201)..(201): a, c, t, g, unknown or other
  modified_base (207)..(207): a, c, t, g, unknown or other
  modified_base (210)..(210): a, c, t, g, unknown or other
  modified_base (213)..(213): a, c, t, g, unknown or other
  modified_base (216)..(216): a, c, t, g, unknown or other
  modified_base (222)..(222): a, c, t, g, unknown or other
  modified_base (225)..(225): a, c, t, g, unknown or other
  modified_base (234)..(234): a, c, t, g, unknown or other
  modified_base (240)..(240): a, c, t, g, unknown or other
  modified_base (249)..(249): a, c, t, g, unknown or other
  modified_base (255)..(255): a, c, t, g, unknown or other
  modified_base (261)..(261): a, c, t, g, unknown or other
  modified_base (270)..(270): a, c, t, g, unknown or other
  modified_base (273)..(273): a, c, t, g, unknown or other
  modified_base (276)..(276): a, c, t, g, unknown or other
  modified_base (279)..(279): a, c, t, g, unknown or other
  modified_base (291)..(291): a, c, t, g, unknown or other
  modified_base (297)..(297): a, c, t, g, unknown or other
  modified_base (309)..(309): a, c, t, g, unknown or other
  modified_base (312)..(312): a, c, t, g, unknown or other
  modified_base (315)..(315): a, c, t, g, unknown or other
  modified_base (324)..(324): a, c, t, g, unknown or other
  modified_base (333)..(333): a, c, t, g, unknown or other
  modified_base (339)..(339): a, c, t, g, unknown or other
  modified_base (357)..(357): a, c, t, g, unknown or other
  modified_base (360)..(360): a, c, t, g, unknown or other
  modified_base (363)..(363): a, c, t, g, unknown or other
  modified_base (369)..(369): a, c, t, g, unknown or other
  modified_base (372)..(372): a, c, t, g, unknown or other
  modified_base (378)..(378): a, c, t, g, unknown or other
  modified_base (384)..(384): a, c, t, g, unknown or other
  modified_base (405)..(405): a, c, t, g, unknown or other
  modified_base (414)..(414): a, c, t, g, unknown or other
  modified_base (426)..(426): a, c, t, g, unknown or other
  modified_base (429)..(429): a, c, t, g, unknown or other
  modified_base (432)..(432): a, c, t, g, unknown or other
  modified_base (435)..(435): a, c, t, g, unknown or other
  modified_base (438)..(438): a, c, t, g, unknown or other
  modified_base (441)..(441): a, c, t, g, unknown or other
  modified_base (450)..(450): a, c, t, g, unknown or other
  modified_base (456)..(456): a, c, t, g, unknown or other
  modified_base (465)..(465): a, c, t, g, unknown or other
  modified_base (474)..(474): a, c, t, g, unknown or other
  modified_base (480)..(480): a, c, t, g, unknown or other
  modified_base (483)..(483): a, c, t, g, unknown or other
  modified_base (492)..(492): a, c, t, g, unknown or other
  modified_base (495)..(495): a, c, t, g, unknown or other
  modified_base (504)..(504): a, c, t, g, unknown or other
  modified_base (510)..(510): a, c, t, g, unknown or other
  modified_base (513)..(513): a, c, t, g, unknown or other
  modified_base (516)..(516): a, c, t, g, unknown or other
  modified_base (522)..(522): a, c, t, g, unknown or other
gtngcnathaaraayytnttyytnytngcngcnacngcngtnwsngtnytngcngcnccnwsnccnytngaygcnmgngcnacntggacntgyathaaycarcarytnaayccnaaracnaayaartgggargayaarmgnytnytntaywsncargcnaargcngarwsnaaywsncaycaygcnccnytnwsngayggnaaracnggnwsnwsntayccngcntggttyacnaayggntaygayggnaayggnaarytnathaarggnmgnacnccnathaarttyggnaargcngaytgygaymgnccnccnaarcaywsncaraayggnatgggnaargaygaycaytayytnytngcnttyccnacnttyccngayggncaygaytayaarttygaywsnaaraarccnaargargayccnggnccngcnmgngtnathtayacntayccnaayaargtnttytgyggnathgtngcncaycarmgnggnaaycarggngayytnmgnytntgywsncay

SEQ ID NO: 63 - DNA, 447 bp, Artificial Sequence
  source: /note="Description of Artificial Sequence: Synthetic polynucleotide"
  source: /note="restrictocin ribotoxic region polynucleotide"
  modified_base (3)..(3): a, c, t, g, unknown or other
  modified_base (6)..(6): a, c, t, g, unknown or other
  modified_base (12)..(12): a, c, t, g, unknown or other
  modified_base (30)..(30): a, c, t, g, unknown or other
  modified_base (36)..(36): a, c, t, g, unknown or other
  modified_base (42)..(42): a, c, t, g, unknown or other
  modified_base (63)..(63): a, c, t, g, unknown or other
  modified_base (66)..(66): a, c, t, g, unknown or other
  modified_base (69)..(69): a, c, t, g, unknown or other
  modified_base (75)..(75): a, c, t, g, unknown or other
  modified_base (81)..(81): a, c, t, g, unknown or other
  modified_base (87)..(87): a, c, t, g, unknown or other
  modified_base (93)..(93): a, c, t, g, unknown or other
  modified_base (99)..(99): a, c, t, g, unknown or other
  modified_base (108)..(108): a, c, t, g, unknown or other
  modified_base (111)..(111): a, c, t, g, unknown or other
  modified_base (114)..(114): a, c, t, g, unknown or other
  modified_base (117)..(117): a, c, t, g, unknown or other
  modified_base (123)..(123): a, c, t, g, unknown or other
  modified_base (129)..(129): a, c, t, g, unknown or other
  modified_base (132)..(132): a, c, t, g, unknown or other
  modified_base (135)..(135): a, c, t, g, unknown or other
  modified_base (138)..(138): a, c, t, g, unknown or other
  modified_base (144)..(144): a, c, t, g, unknown or other
  modified_base (147)..(147): a, c, t, g, unknown or other
  modified_base (156)..(156): a, c, t, g, unknown or other
  modified_base (162)..(162): a, c, t, g, unknown or other
  modified_base (171)..(171): a, c, t, g, unknown or other
  modified_base (177)..(177): a, c, t, g, unknown or other
  modified_base (183)..(183): a, c, t, g, unknown or other
  modified_base (192)..(192): a, c, t, g, unknown or other
  modified_base (195)..(195): a, c, t, g, unknown or other
  modified_base (198)..(198): a, c, t, g, unknown or other
  modified_base (201)..(201): a, c, t, g, unknown or other
  modified_base (213)..(213): a, c, t, g, unknown or other
  modified_base (219)..(219): a, c, t, g, unknown or other
  modified_base (231)..(231): a, c, t, g, unknown or other
  modified_base (234)..(234): a, c, t, g, unknown or other
  modified_base (237)..(237): a, c, t, g, unknown or other
  modified_base (246)..(246): a, c, t, g, unknown or other
  modified_base (255)..(255): a, c, t, g, unknown or other
  modified_base (261)..(261): a, c, t, g, unknown or other
  modified_base (279)..(279): a, c, t, g, unknown or other
  modified_base (282)..(282): a, c, t, g, unknown or other
  modified_base (285)..(285): a, c, t, g, unknown or other
  modified_base (291)..(291): a, c, t, g, unknown or other
  modified_base (294)..(294): a, c, t, g, unknown or other
  modified_base (300)..(300): a, c, t, g, unknown or other
  modified_base (306)..(306): a, c, t, g, unknown or other
  modified_base (327)..(327): a, c, t, g, unknown or other
  modified_base (336)..(336): a, c, t, g, unknown or other
  modified_base (348)..(348): a, c, t, g, unknown or other
  modified_base (351)..(351): a, c, t, g, unknown or other
  modified_base (354)..(354): a, c, t, g, unknown or other
  modified_base (357)..(357): a, c, t, g, unknown or other
  modified_base (360)..(360): a, c, t, g, unknown or other
  modified_base (363)..(363): a, c, t, g, unknown or other
  modified_base (372)..(372): a, c, t, g, unknown or other
  modified_base (378)..(378): a, c, t, g, unknown or other
  modified_base (387)..(387): a, c, t, g, unknown or other
  modified_base (396)..(396): a, c, t, g, unknown or other
  modified_base (402)..(402): a, c, t, g, unknown or other
  modified_base (405)..(405): a, c, t, g, unknown or other
  modified_base (414)..(414): a, c, t, g, unknown or other
  modified_base (417)..(417): a, c, t, g, unknown or other
  modified_base (426)..(426): a, c, t, g, unknown or other
  modified_base (432)..(432): a, c, t, g, unknown or other
  modified_base (435)..(435): a, c, t, g, unknown or other
  modified_base (438)..(438): a, c, t, g, unknown or other
  modified_base (444)..(444): a, c, t, g, unknown or other
gcnacntggacntgyathaaycarcarytnaayccnaaracnaayaartgggargayaarmgnytnytntaywsncargcnaargcngarwsnaaywsncaycaygcnccnytnwsngayggnaaracnggnwsnwsntayccngcntggttyacnaayggntaygayggnaayggnaarytnathaarggnmgnacnccnathaarttyggnaargcngaytgygaymgnccnccnaarcaywsncaraayggnatgggnaargaygaycaytayytnytngcnttyccnacnttyccngayggncaygaytayaarttygaywsnaaraarccnaargaraayccnggnccngcnmgngtnathtayacntayccnaayaargtnttytgyggnathgtngcncaycarmgnggnaaycarggngayytnmgnytntgywsncay

SEQ ID NO: 64 - DNA, 528 bp, Artificial Sequence
  source: /note="Description of Artificial Sequence: Synthetic polynucleotide"
  source: /note="clavin ribotoxic region polynucleotide"
  modified_base (3)..(3): a, c, t, g, unknown or other
  modified_base (6)..(6): a, c, t, g, unknown or other
  modified_base (18)..(18): a, c, t, g, unknown or other
  modified_base (21)..(21): a, c, t, g, unknown or other
  modified_base (24)..(24): a, c, t, g, unknown or other
  modified_base (27)..(27): a, c, t, g, unknown or other
  modified_base (30)..(30): a, c, t, g, unknown or other
  modified_base (33)..(33): a, c, t, g, unknown or other
  modified_base (36)..(36): a, c, t, g, unknown or other
  modified_base (39)..(39): a, c, t, g, unknown or other
  modified_base (42)..(42): a, c, t, g, unknown or other
  modified_base (45)..(45): a, c, t, g, unknown or other
  modified_base (48)..(48): a, c, t, g, unknown or other
  modified_base (51)..(51): a, c, t, g, unknown or other
  modified_base (54)..(54): a, c, t, g, unknown or other
  modified_base (60)..(60): a, c, t, g, unknown or other
  modified_base (63)..(63): a, c, t, g, unknown or other
  modified_base (66)..(66): a, c, t, g, unknown or other
  modified_base (69)..(69): a, c, t, g, unknown or other
  modified_base (78)..(78): a, c, t, g, unknown or other
  modified_base (81)..(81): a, c, t, g, unknown or other
  modified_base (84)..(84): a, c, t, g, unknown or other
  modified_base (87)..(87): a, c, t, g, unknown or other
  modified_base (93)..(93): a, c, t, g, unknown or other
  modified_base (117)..(117): a, c, t, g, unknown or other
  modified_base (123)..(123): a, c, t, g, unknown or other
  modified_base (144)..(144): a, c, t, g, unknown or other
  modified_base (147)..(147): a, c, t, g, unknown or other
  modified_base (150)..(150): a, c, t, g, unknown or other
  modified_base (168)..(168): a, c, t, g, unknown or other
  modified_base (174)..(174): a, c, t, g, unknown or other
  modified_base (180)..(180): a, c, t, g, unknown or other
  modified_base (189)..(189): a, c, t, g, unknown or other
  modified_base (192)..(192): a, c, t, g, unknown or other
  modified_base (195)..(195): a, c, t, g, unknown or other
  modified_base (198)..(198): a, c, t, g, unknown or other
  modified_base (204)..(204): a, c, t, g, unknown or other
  modified_base (210)..(210): a, c, t, g, unknown or other
  modified_base (213)..(213): a, c, t, g, unknown or other
  modified_base (216)..(216): a, c, t, g, unknown or other
  modified_base (219)..(219): a, c, t, g, unknown or other
  modified_base (225)..(225): a, c, t, g, unknown or other
  modified_base (228)..(228): a, c, t, g, unknown or other
  modified_base (237)..(237): a, c, t, g, unknown or other
  modified_base (243)..(243): a, c, t, g, unknown or other
  modified_base (252)..(252): a, c, t, g, unknown or other
  modified_base (258)..(258): a, c, t, g, unknown or other
  modified_base (267)..(267): a, c, t, g, unknown or other
  modified_base (273)..(273): a, c, t, g, unknown or other
  modified_base (276)..(276): a, c, t, g, unknown or other
  modified_base (279)..(279): a, c, t, g, unknown or other
  modified_base (282)..(282): a, c, t, g, unknown or other
  modified_base (294)..(294): a, c, t, g, unknown or other
  modified_base (300)..(300): a, c, t, g, unknown or other
  modified_base (312)..(312): a, c, t, g, unknown or other
  modified_base (315)..(315): a, c, t, g, unknown or other
  modified_base (318)..(318): a, c, t, g, unknown or other
  modified_base (327)..(327): a, c, t, g, unknown or other
  modified_base (336)..(336): a, c, t, g, unknown or other
  modified_base (342)..(342): a, c, t, g, unknown or other
  modified_base (360)..(360): a, c, t, g, unknown or other
  modified_base (363)..(363): a, c, t, g, unknown or other
  modified_base (366)..(366): a, c, t, g, unknown or other
  modified_base (372)..(372): a, c, t, g, unknown or other
  modified_base (375)..(375): a, c, t, g, unknown or other
  modified_base (381)..(381): a, c, t, g, unknown or other
  modified_base (387)..(387): a, c, t, g, unknown or other
  modified_base (408)..(408): a, c, t, g, unknown or other
  modified_base (417)..(417): a, c, t, g, unknown or other
  modified_base (429)..(429): a, c, t, g, unknown or other
  modified_base (432)..(432): a, c, t, g, unknown or other
  modified_base (435)..(435): a, c, t, g, unknown or other
  modified_base (438)..(438): a, c, t, g, unknown or other
  modified_base (441)..(441): a, c, t, g, unknown or other
  modified_base (444)..(444): a, c, t, g, unknown or other
  modified_base (453)..(453): a, c, t, g, unknown or other
  modified_base (459)..(459): a, c, t, g, unknown or other
  modified_base (468)..(468): a, c, t, g, unknown or other
  modified_base (477)..(477): a, c, t, g, unknown or other
  modified_base (483)..(483): a, c, t, g, unknown or other
  modified_base (486)..(486): a, c, t, g, unknown or other
  modified_base (492)..(492): a, c, t, g, unknown or other
  modified_base (495)..(495): a, c, t, g, unknown or other
  modified_base (507)..(507): a, c, t, g, unknown or other
  modified_base (513)..(513): a, c, t, g, unknown or other
  modified_base (519)..(519): a, c, t, g, unknown or other
  modified_base (525)..(525): a, c, t, g, unknown or other
gtngcnathaaraayytngtnytngtngcnytnacngcngtnacngcnytngcnatgccnwsnccnytngargarmgngcngcnacntggacntgyatgaaygarcaraaraayccnaaracnaayaartaygaraayaarmgnytnytntayaaycaraayaaygcngarwsnaaygcncaycaygcnccnytnwsngayggnaaracnggnwsnwsntayccngcntggttyacnaayggntaygayggngayggnaarathytnaarggnmgnacnccnathaartggggnaaywsngaytgygaymgnccnccnaarcaywsnaaraayggngayggnaaraaygaycaytayytnytngcnttyccnacnttyccngayggncaycartayaayttygaywsnaaraarccnaargargayccnggnccngcnmgngtnathtayacntayccnaayaargtnttytgyggnathgtngcncayacnmgngaraaycarggngayytnaarytntgywsncay

The invention is claimed as follows:

1. A method for isolating a binding region for use in constructing one or more chimeric cytotoxic protein, wherein the one or more chimeric cytotoxic protein comprises:
  i) a ribotoxic region comprising a polypeptide and capable of inactivating a ribosome, and
  ii) a binding region comprising a polypeptide and capable of binding at least one target biomolecule;
the method comprising the steps of:
  a) providing a plurality of chimeric proteins, each protein comprising:
    i) a modified ribotoxic region comprising at least one amino acid substitution, deletion, insertion, or addition as compared to a corresponding unmodified ribotoxin region, so as to reduce or eliminate ribotoxicity of the modified ribotoxic region, and
    ii) a binding region comprising a polypeptide and capable of binding at least one target biomolecule;
  b) screening the plurality of chimeric proteins to isolate a chimeric protein with at least one assay-screenable characteristic selected from:
    target biomolecule binding affinity, target biomolecule binding selectivity, target cell binding affinity, target cell binding selectivity, target cell internalization, and expression level; and
  c) identifying the amino acid sequence of a binding region of the chimeric protein isolated in step b), or optionally identifying an additional amino acid sequence(s) of the protein isolated in step b), including all the amino acid sequences of the chimeric protein isolated in step b), in order to construct one or more chimeric cytotoxic protein comprising
    (i) a binding region consisting essentially of, comprising, or derived from the identified amino acid sequence of the binding region of the chimeric protein isolated in step b) and capable of binding at least one target biomolecule; and
    (ii) a ribotoxic region capable of inactivating a ribosome and which is more ribotoxic than a modified ribotoxic region present in a chimeric protein provided in step a).

2. The method of claim 1, further comprising the step of:
  d) producing the one or more chimeric cytotoxic protein, wherein the producing step comprises:
    i) providing one or more polynucleotides encoding the one or more chimeric cytotoxic protein comprising the identified amino acid sequence of the binding region identified in step c), or optionally, encoding one or more chimeric cytotoxic protein consisting essentially of or derived from the amino acid sequence of the chimeric protein identified in step c); and
    ii) expressing the one or more polynucleotides using a host cell or cell-free translation system.

3. The method of claim 1, wherein the one or more chimeric cytotoxic protein is a fusion polypeptide comprising the ribotoxin region fused, either directly or indirectly, to the binding region.

4. The method of claim 3, wherein the plurality of chimeric proteins is a plurality of fusion polypeptides, each fusion polypeptide comprising the modified ribotoxin region fused, either directly or indirectly, to a binding region comprising a polypeptide and capable of binding at least one target biomolecule.

5. The method of claim 4, wherein the modified ribotoxic region is derived from a toxin selected from the group consisting of:
  abrin, agrostin, amarandin, amaranthin, Amaranthus antiviral/RIP, angiogenin, *A. patens* RIP, Articulatin D, aspirin, aspergillin, Aspf1, balsamin, *B. hispida* RIP, bouganin, *Bougainvillea×buttiana* antiviral protein 1, benincasin, bouganin, *B. rubra* RIP, bryodin, *B. spectabilis* RIP, *B. vulgaris* RIP, *C. album* RIP, camphorin, *C. aculeatum*-systemic resistance inducing protein, *C. cristata* RIP, *C. figarei* RIP, charantin, charybdin, cinnamomin, clavin, *C. moschata* RIP, cochinin B, colocins, crotin, cucurmosin, curcin, *Dianthus* spp. RIP, *Corynebacterium* spp. diphtheria toxin, dodecandrin, ebulin, ebulitin, *E. hyemalis* RIP, euserratin, eutirucallin, flammin, flammulin, foetidissimin, gelonin, gigantin, gypsophilin, *H. crepitans* RIP, Heterotepalin, hispin, hirsutellin A, *H. orientalis* RIP, *H. vulgare* RIP, hypsin, insularin, *I. hollandica* RIP, lagenin, lamjapin, lanceolin, *L. cylindrical* RIP, luffacylin, luffaculin, luffagulin, luffin, *L. usitatissimum* RIP, lychnin, lyophyllin, manutin, marmorin, mapalmin, *M. charantia* lectin, *M. crystallinum* RIP, melonin, mexin, *Mirabilis* spp. RIP, mitogillin, modeccin, MOR, *Mormordica* spp. momorsgrovin, moschatin, musarmin, *N. tabacum* RIP, nigrin, nigritin, ocymoidin, pachyerosin, *P. californicum* lectin, pepocin, petroglaucin, petrograndin, *Phytolacca* spp. RIP, pisavin, pleuturegin, Pluturegin, *A. thaliana* pectin methyl transferase, *P. multiforum* RIP, pokeweed antiviral protein, porrectin, *Aeromonas* spp. *Pseudomonas* toxin (*A. hydrophile pseudomonas*-like toxin), pulchellin, quinqueginsin, *R. communis* agglutinin, restrictocin, ricin, riproximin, saporin, sarcin, sativinn, *S. cereale* RIP, sechiumin, Shiga toxin, Shiga-like toxin, sieboldin b, *S. nigra* RIP, *S. ocymoides* RIP, *Spinacia oleracea* protein, stellarin, stenodactylin, texanin, tricholin, *Trichosanthes* spp. RIP, *Triticum* spp. RIP, *V. album* RIP, velin, velutin, verotoxin, *V. hispanica* RIP, vircumin, volkensin, *V. volvacea* RIP, Volvarin, Yucca leaf protein, *Z. diploperennis* RIP, *Z. mays* RIP, and any ribotoxic fragment of any of the foregoing capable of inactivating a ribosome.

6. The method of claim 5, further comprising before step a), the steps of:
a') providing an expression library of diverse nucleic acids constructed from a plurality of polynucleotides encoding a plurality of fusion polypeptides;
b') expressing the expression library of diverse nucleic acids such that a plurality of chimeric proteins comprising fusion polypeptides is produced and wherein each fusion polypeptide comprises
i) a modified ribotoxic region comprising at least one amino acid substitution, deletion, insertion, or addition as compared to a corresponding unmodified ribotoxin region, so as to reduce or eliminate ribotoxicity of the modified ribotoxic region; and
ii) a binding region comprising a polypeptide and capable of binding at least one target biomolecule; and
c') providing the expressed plurality of chimeric proteins as the plurality of chimeric proteins for step a).

7. The method of claim 6, further comprising before step a'), the steps of:
a") providing a library comprising a plurality of diverse polynucleotides encoding a plurality of binding regions, wherein at least two subsets of polynucleotides encode polypeptides with different binding regions capable of binding at least one target biomolecule;
b") joining the polynucleotides of the library in an operable combination to a toxin template polynucleotide encoding a modified ribotoxic region (comprising at least one amino acid substitution, deletion, insertion, or addition as compared to a corresponding unmodified ribotoxin region, so as to reduce or eliminate ribotoxicity of the modified ribotoxic region) to construct an expression library of diverse nucleic acids that encode a plurality of fusion polypeptides, each fusion polypeptide comprising a binding region fused with the modified ribotoxic region, and optionally recombining the polynucleotides of the library of joined polynucleotides to an expression polynucleotide template to construct an expression library of diverse nucleic acids capable of expressing a plurality of fusion polypeptides, each fusion polypeptide comprising a binding region fused to the modified ribotoxic region; and
c") providing the expression library as the expression library of diverse nucleic acids constructed from a plurality of polynucleotides encoding a plurality of fusion polypeptides for step a').

8. The method of claim 6, wherein the binding region comprises a polypeptide selected from the group consisting of:
complementary determining region 3 fragment, constrained FR3-CDR3-FR4 polypeptide, single-domain antibody fragment, single-chain variable fragment, antibody variable fragment, antigen-binding fragment, Fd fragment, fibronectin-derived $10^{th}$ fibronectin type III domain, tenascin type III domain, ankyrin repeat motif domain, low-density-lipoprotein-receptor-derived A-domain, lipocalin, Kunitz domain, Protein-A-derived Z domain, gamma-B crystallin-derived domain, ubiquitin-derived domain, Sac7d-derived polypeptide, Fyn-derived SH2 domain, and any genetically manipulated counterparts of any of the foregoing that retain binding functionality.

9. The method of claim 8, wherein the expression library is operable using a protein display method selected from the group consisting of:
bacteriophage display, RNA display, ribosome display, DNA display, bead surface display, virus display, microorganism display, and mammalian cell display.

10. The method of claim 9, wherein at least one binding region is capable of binding to a target biomolecule found in physical association with at least one type of malignant cell.

11. The method of claim 10, wherein the modified ribotoxic region comprises or consists of an amino acid sequence that has at least 90%, 95%, 97%, 98%, 99%, 99.5%, or 99.7% sequence identity to a sequence selected from any one of SEQ ID NOs: 1-39 or a ribotoxic fragment thereof.

12. A method for producing a nucleic acid encoding a chimeric cytotoxic protein, wherein the chimeric cytotoxic protein comprises a ribotoxin region, which is capable of inactivating a ribosome, fused either directly or indirectly to a binding region capable of binding at least one target biomolecule; the method comprising the steps of:
a) identifying an amino acid sequence of a binding region of a chimeric protein isolated using a method according to any one of claims 1-11; and
b) creating a nucleic acid encoding the chimeric cytotoxic protein
wherein the binding region consists essentially of, comprises, or is derived from the identified amino acid sequence of the binding region of the chimeric protein identified in step a), and
wherein the ribotoxic region is more ribotoxic than a modified ribotoxic region of a chimeric protein of step a) of claim 1 according to a method of any one of claims 1-11.

13. A method for isolating a protein for use in one or more chimeric cytotoxic protein,
wherein the one or more chimeric cytotoxic protein comprises:
i) a ribotoxic region comprising a polypeptide and capable of inactivating a ribosome, and
ii) a binding region comprising a polypeptide and capable of binding at least one target biomolecule;

the method comprising the steps of:
a) providing a plurality of chimeric cytotoxic proteins, each protein comprising:
   i) a ribotoxic region comprising a polypeptide and capable of inactivating a ribosome, and
   ii) a binding region comprising a polypeptide and capable of binding at least one target biomolecule;
b) screening the plurality of chimeric cytotoxic proteins in the presence of an inhibitor of the ribotoxic region to isolate a chimeric cytotoxic protein with at least one assay-screenable characteristic, wherein the at least one characteristic is selected from: target biomolecule binding affinity, target biomolecule binding selectivity, target cell binding affinity, target cell binding selectivity, target cell internalization, and expression level; and
c) identifying the amino acid sequence of a binding region of the chimeric cytotoxic protein isolated in step b), or optionally, identifying an additional amino acid sequence(s) of the chimeric cytotoxic protein identified in step b), including all the amino acid sequences of the chimeric cytotoxic protein isolated in step b).

14. The method of claim 13, wherein the one or more chimeric cytotoxic protein is a fusion polypeptide comprising the ribotoxin region fused, either directly or indirectly, to the binding region.

15. The method of claim 14, wherein the plurality of chimeric cytotoxic proteins is a plurality of fusion polypeptides, each fusion polypeptide comprising the ribotoxin region fused, either directly or indirectly, to the binding region.

16. The method of claim 15, wherein the plurality of chimeric cytotoxic proteins is produced from an expression library of diverse nucleic acids operable using a protein display method selected from the group consisting of:
bacteriophage display, RNA display, ribosome display, DNA display, bead surface display, virus display, microorganism display, and mammalian cell display.

17. The method of claim 15, further comprising the step of:
d) producing the one or more chimeric cytotoxic protein consisting essentially of, comprising, or derived from the identified amino acid sequence of the chimeric cytotoxic protein; wherein the producing step comprises:
   i) providing one or more polynucleotides encoding the one or more chimeric cytotoxic protein and
   ii) expressing the one or more polynucleotides using a host cell or cell-free translation system.

18. The method of claim 15, further comprising before step a), the steps of:
a') providing an expression library of diverse nucleic acids constructed from a plurality of polynucleotides encoding a plurality of fusion polypeptides, each fusion polypeptide comprising:
   i) a ribotoxic region capable of inactivating a ribosome and
   ii) a binding region capable of binding at least one target biomolecule;
b') expressing the expression library of diverse nucleic acids such that a plurality of fusion polypeptides is produced; and
c') providing the plurality of fusion polypeptides as the plurality of chimeric cytotoxic proteins for step a).

19. The method of claim 18, further comprising before step a'), the steps of:

a") providing a library comprising a plurality of diverse polynucleotides encoding a plurality of binding regions, wherein at least two subsets of polynucleotides encode polypeptides with different binding regions capable of binding at least one target biomolecule;
b") joining the polynucleotides of the library to a toxin template polynucleotide encoding a ribotoxic region in an operable combination to construct an expression library of diverse nucleic acids that encode a plurality of fusion polypeptides, each fusion polypeptide comprising the ribotoxic region and one of the binding regions, and optionally recombining the polynucleotides of the library of polynucleotides to an expression polynucleotide template to construct an expression library of diverse nucleic acids capable of expressing a plurality of fusion polypeptides, each fusion polypeptide comprising the ribotoxic region and a binding region; and
c") providing the expression library as the expression library of diverse nucleic acids constructed from a plurality of polynucleotides encoding a plurality of fusion polypeptides for step a').

20. The method of claim 15, wherein the ribotoxic region is derived from a toxin selected from the group consisting of: abrin, agrostin, amarandin, amaranthin, Amaranthus antiviral/RIP, angiogenin, *A. patens* RIP, Articulatin D, asparin, aspergillin, Aspf1, balsamin, *B. hispida* RIP, bouganin, *Bougainvillea×buttiana* antiviral protein 1, benincasin, bouganin, *B. rubra* RIP, bryodin, *B. spectabilis* RIP, *B. vulgaris* RIP, *C. album* RIP, camphorin, *C. aculeatum*-systemic resistance inducing protein, *C. cristata* RIP, *C. figarei* RIP, charantin, charybdin, cinnamomin, clavin, *C. moschata* RIP, cochinin B, colocins, crotin, cucurmosin, curcin, *Dianthus* spp. RIP, *Corynebacterium* spp. diphtheria toxin, dodecandrin, ebulin, ebulitin, *E. hyemalis* RIP, euserratin, eutirucallin, flammin, flammulin, foetidissimin, gelonin, gigantin, gypsophilin, *H. crepitans* RIP, Heterotepalin, hispin, hirsutellin A, *H. orientalis* RIP, *H. vulgare* RIP, hypsin, insularin, *I. hollandica* RIP, lagenin, lamjapin, lanceolin, *L. cylindrical* RIP, luffacylin, luffaculin, luffagulin, luffin, *L. usitatissimum* RIP, lychnin, lyophyllin, manutin, marmorin, mapalmin, *M. charantia* lectin, *M. crystallinum* RIP, melonin, mexin, *Mirabilis* spp. RIP, mitogillin, modeccin, MOR, *Mormordica* spp. momorsgrovin, moschatin, musarmin, *N. tabacum* RIP, nigrin, nigritin, ocymoidin, pachyerosin, *P. californicum* lectin, pepocin, petroglaucin, petrograndin, *Phytolacca* spp. RIP, pisavin, pleuturegin, Pluturegin, *A. thaliana* pectin methyl transferase, *P. multiform* RIP, pokeweed antiviral protein, porrectin, *Aeromonas* spp. *Pseudomonas* toxin (*A. hydrophile pseudomonas*-like toxin), pulchellin, quinqueginsin, *R. communis* agglutinin, restrictocin, ricin, riproximin, saporin, sarcin, sativin, *S. cereale* RIP, sechiumin, Shiga toxin, Shiga-like toxin, sieboldin b, *S. nigra* RIP, *S. ocymoides* RIP, *Spinacia oleracea* protein, stellarin, stenodactylin, texanin, tricholin, *Trichosanthes* spp. RIP, *Triticum* spp. RIP, *V. album* RIP, velin, velutin, verotoxin, *V. hispanica* RIP, vircumin, volkensin, *V. volvacea* RIP, Volvarin, Yucca leaf protein, *Z. diploperennis* RIP, *Z. mays* RIP, and any ribotoxic fragment of any of the foregoing capable of inactivating a ribosome.

21. The method of claim 15, wherein the binding region comprises a polypeptides selected from the group consisting of:

complementary determining region 3 fragment, constrained FR3-CDR3-FR4 polypeptide, single-domain antibody fragment, single-chain variable fragment, antibody variable fragment, antigen-binding fragment, Fd fragment, fibronectin-derived $10^{th}$ fibronectin type III domain, tenascin type III domain, ankyrin repeat motif domain, low-density-lipoprotein-receptor-derived A-domain, lipocalin, Kunitz domain, Protein-A-derived Z domain, gamma-B crystallin-derived domain, ubiquitin-derived domain, Sac7d-derived polypeptide, Fyn-derived SH2 domain, and any genetically manipulated counterparts of any of the foregoing that retain binding functionality.

22. The method of claim 21, wherein at least one binding region is capable of binding to a target biomolecule found in physical association with at least one type of malignant cell.

23. A method for producing a nucleic acid encoding a chimeric cytotoxic protein, the method comprising the steps of:

a) identifying an amino acid sequence of a binding region of a chimeric cytotoxic protein, or optionally identifying all the amino acid sequences of a chimeric cytotoxic protein, isolated using a method according to any one of claims 13-22; and b) creating a nucleic acid encoding a chimeric cytotoxic protein comprising i) a binding region consisting essentially of, comprising, or derived from the amino acid sequence of the binding region of the chimeric protein identified in step a) and capable of binding at least one target biomolecule; and ii) a ribotoxic region capable of inactivating a ribosome; wherein the binding region and ribotoxic region are fused, either directly or indirectly, and optionally wherein the nucleic acid encodes a chimeric cytotoxic protein derived from, comprising, or consisting essentially of the chimeric cytotoxic protein identified in step a).

\* \* \* \* \*